United States Patent 11,446,398 (REGULATED BIOCIRCUIT SYSTEMS) - sequence listing, part 42

SEQ ID NO: 130117 - DNA, 3222 bp, Homo sapiens
  Payload ID: 5456
  Gene Symbol: EPHB6
  Gene Name: EPH receptor B6
  ENST ID: ENST00000631900
  CDS Start-End: 278-829
caagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggctgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctccgatggctgcattccctggtcctccgcctctccaccagccccctcctcattaaagggaaagaagggaa

SEQ ID NO: 130118 - DNA, 1444 bp, Homo sapiens
  Payload ID: 5457
  Gene Symbol: EFNA1
  Gene Name: ephrin-A1
  Uniprot ID: P20827
  ENST ID: ENST00000368406
  CDS Start-End: 103-654
agatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctctcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 130119 - DNA, 1926 bp, Homo sapiens
  Payload ID: 5457
  Gene Symbol: EFNA1
  Gene Name: ephrin-A1
  Uniprot ID: P20827
  ENST ID: ENST00000368407
  CDS Start-End: 519-1136
atgcgaggctcagaaaggtgcggggcatgtcaacaacctcgcaccctgcaaggtccgcgcgcggagcagcaaagccgtgtcccgcacccccgcgttcgcagactcgcacttgcgagttcttcccttctcccgcacgcgactgcgcccagggacgcaagcccaccaccgggacaggctcacaaagctccacgcagacccacaagtgagcgaacacacatctctgagcagatctgcgggggcagaggagcgcgcttcgctctttcctgcacccccagcctcctcgcctccccaccccgcccctcctccacctccccagcccccaagcccccaggcagccgcgcgccgggcggggcgagggcggggcggggtgtcgggcggcgccggcccaaaaggcggagtcgctaggcgaaggggccagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 130120 - DNA, 949 bp, Homo sapiens
  Payload ID: 5458
  Gene Symbol: EFNA2
  Gene Name: ephrin-A2
  Uniprot ID: O43921
  ENST ID: ENST00000215368
  CDS Start-End: 16-657
ggccggaccggggccatggcgcccgcgcagcgcccgctgctcccgctgctgctcctgctgttaccgctgccgccgccgcccttcgcgcgcgccgaggacgccgcccgcgccaactcggaccgctacgccgtctactggaaccgcagcaaccccaggttccacgcaggcgcgggggacgacggcgggggctacacggtggaggtgagcatcaatgactacctggacatctactgcccgcactatggggcgccgctgccgccggccgagcgcatggagcactacgtgctgtacatggtcaacggcgagggccacgcctcctgcgaccaccgccagcgcggcttcaagcgctgggagtgcaaccggcccgcggcgcccggggggccgctcaagttctcggagaagttccagctcttcacgcccttctccctgggcttcgagttccggcccggccacgagtattactacatctctgccacgcctcccaatgctgtggaccggccctgcctgcgactgaaggtgtacgtgcggccgaccaacgagaccctgtacgaggctcctgagcccatcttcaccagcaataactcgtgtagcagcccgggcggctgccgcctcttcctcagcaccatccccgtgctctggaccctcctgggttcctagtcccagccccgcaggacgccgaccctgcctggacggccccgcctggaccgcctgacctcggccctccggacccggctgcggcccccgcctccgagaccaaatagagacgctgcttctccctcgcctggtgccgcccccgccgggcaggggccatccacccgccccaggaccagccctcagggaggggaaacggccgagagcccccccccggaggcccgaggggccggggtgtggatgcggaccgtggccaggccatctcctctggggcgtcggagaacccgggaacctcttg

SEQ ID NO: 130121 - DNA, 1782 bp, Homo sapiens
  Payload ID: 5459
  Gene Symbol: EFNA3
  Gene Name: ephrin-A3
  Uniprot ID: P52797
  ENST ID: ENST00000368408
  CDS Start-End: 71-787
ggagctgggaagcggagaagccgggagcgcggggctcagtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacaacgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataa

SEQ ID NO: 130122 - DNA, 1096 bp, Homo sapiens
  Payload ID: 5460
  Gene Symbol: EFNA4
  Gene Name: ephrin-A4
  Uniprot ID: P52798
  ENST ID: ENST00000359751
  CDS Start-End: 88-669
cttccctcttcactttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttt

SEQ ID NO: 130123 - DNA, 1263 bp, Homo sapiens
  Payload ID: 5460
  Gene Symbol: EFNA4
  Gene Name: ephrin-A4
  Uniprot ID: P52798
  ENST ID: ENST00000368409
  CDS Start-End: 94-699
ccgcaacttccctcttcactttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaagtctgagtcagcccatcctgttgggagccctggagagagtggcacatcagggtggcgagggggggacactcccagccccctctgtctcttgctattactgctgcttctgattcttcgtcttctgcgaattctgtgagccaagcagaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaa

SEQ ID NO: 130124 - DNA, 1052 bp, Homo sapiens
  Payload ID: 5460
  Gene Symbol: EFNA4
  Gene Name: ephrin-A4
  Uniprot ID: P52798
  ENST ID: ENST00000427683
  CDS Start-End: 64-687
ctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggagagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttt

SEQ ID NO: 130125 - DNA, 5335 bp, Homo sapiens
  Payload ID: 5461
  Gene Symbol: EFNA5
  Gene Name: ephrin-A5
  Uniprot ID: P52803
  ENST ID: ENST00000333274
  CDS Start-End: 283-969
gcttctctccatcttgtgattcctttttcctcctgaaccctccagtgggggtgcgagtttgtctttatcaccccccatcccaccgccttcttttcttctcgctctcctacccctccccagcttggtgggcgcctctttcctttctcgcccactttcatttttatttattcatatttatttggcgcccgctctctctctgtccctttgcctgcctccctccctccggatccccgctctctccccggagtggcgcgtcgggggctccgccgctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggtttttttttttaatatgactgtcttaaagcattcttgacagcaaaacttgtgctctctaaaagaagccttttttttttttctaggaggcaggttgggtgtggaatgctaatacagagcaggtgtgaaaacagagaaaactacaggtttgctgggggtgtgtatgtgtgagtgcctctaatttttttggtgactgggcagtgcacaccagatattttttctttgaatacagatcaccatggtgctacaactttttttttttttttttttttttttttttttttttttaagaaactcaaagaggcatttttatgaataaagtgaccttccccaaggctgacaagccagggttgatgagtgcatagtggaatagctttggatactcctctgggggatgacatgtaccaaggagaggaccgcagtggccagaggagacatgatttggctttgctggagcgccagtgtgctgtggcctttccccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgttgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattgga

SEQ ID NO: 130126 - DNA, 637 bp, Homo sapiens
  Payload ID: 5461
  Gene Symbol: EFNA5
  Gene Name: ephrin-A5
  ENST ID: ENST00000509503
  CDS Start-End: 15-620
gctggccaggcgtgatgttgcacgtggagatgttgacgctggtgtttctggtgctctggatgtgtgtgttcagccaggacccgggctccaaggccgtcgccgaccgctacgctgtctactggaacagcagcaaccccagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatgacaccgtacatgagtcagccgagccatcccgcggcgagaacgcggcacaaacaccaaggatacccagccgccttttggcaatcctactgttcctcctggcgatgcttttgacattatagcacagtctcctcccatc

SEQ ID NO: 130127 - DNA, 4933 bp, Homo sapiens
  Payload ID: 5461
  Gene Symbol: EFNA5
  Gene Name: ephrin-A5
  ENST ID: ENST00000611503
  CDS Start-End: 1-567
aacagattccagaggggtgactaccatattgatgtctgtatcaatgactacctggatgttttctgccctcactatgaggactccgtcccagaagataagactgagcgctatgtcctctacatggtgaactttgatggctacagtgcctgcgaccacacttccaaagggttcaagagatgggaatgtaaccggcctcactctccaaatggaccgctgaagttctctgaaaaattccagctcttcactcccttttctctaggatttgaattcaggccaggccgagaatatttctacatctcctctgcaatcccagataatggaagaaggtcctgtctaaagctcaaagtctttgtgagaccaacaaatagctgtatgaaaactataggtgttcatgatcgtgttttcgatgttaacgacaaagtagaaaattcattagaaccagcagatgacaccgtacatgagtcagccgagccatcccgcggcgagaacgcggcacaaacaccaaggatacccagccgccttttggcaatcctactgttcctcctggcgatgcttttgacattatagcacagtctcctcccatcacttgtcacagaaaacatcagggtcttggaacaccagagatccacctaactgctcatcctaagaagggacttgttattgggttttggcagatgtcagatttttgttttctttctttcagcctgaattctaagcaacaacttcaggttgggggcctaaacttgttcctgcctccctcaccccaccccgccccacccccagccctggcccttggcttctctcacccctcccaaattaaatggactccagatgaaaatgccaaattgtcatagtgacaccagtggttcgtcagctcctgtgcattctcctctaagaactcacctccgttagcgcactgtgtcagcgggctatggacaaggaagaatagtggcagatgcagccagcgctggctagggctgggagggttttgctctcctatgcaatatttatgccttctcattcagaactgtaagatgatcgcgcagggcatcatgtcaccatgtcaggtccggaggggaggtattaagaatagatacgatattacaccatttcctataggagtatgtaaatgaacaggcttctaaaaggttgagacactggtttttttttttaatatgactgtcttaaagcattcttgacagcaaaacttgtgctctctaaaagaagccttttttttttttctaggaggcaggttgggtgtggaatgctaatacagagcaggtgtgaaaacagagaaaactacaggtttgctgggggtgtgtatgtgtgagtgcctctaatttttttggtgactgggcagtgcacaccagatattttttctttgaatacagatcaccatggtgctacaactttttttttttttttttttttttttttttttttttttaagaaactcaaagaggcatttttatgaataaagtgaccttccccaaggctgacaagccagggttgatgagtgcatagtggaatagctttggatactcctctgggggatgacatgtaccaaggagaggaccgcagtggccagaggagacatgatttggctttgctggagcgccagtgtgctgtggcctttccccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgttgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattgga

SEQ ID NO: 130128 - DNA, 3314 bp, Homo sapiens
  Payload ID: 5462
  Gene Symbol: EFNB1
  Gene Name: ephrin-B1
  Uniprot ID: P98172
  ENST ID: ENST00000204961
  CDS Start-End: 781-1821
gcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaa

SEQ ID NO: 130129 - DNA, 4461 bp, Homo sapiens
  Payload ID: 5463
  Gene Symbol: EFNB2
  Gene Name: ephrin-B2
  Uniprot ID: P52799
  ENST ID: ENST00000245323
  CDS Start-End: 151-1152
gaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattcctcgaactccaaatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatctacatcaaatgggtctttggagggcctggataaccaggagggaggggtgtgccagacaagagccatgaagatcctcatgaaagttggacaagatgcaagttctgctggatcaaccaggaataaagatccaacaagacgtccagaactagaagctggtacaaatggaagaagttcgacaacaagtccctttgtaaaaccaaatccaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggggactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcggaagagcccgtcgcgctggacagcttacctagtcttgtagcattcggccttggtgaacacacacgctccctggaagctggaagactgtgcagaagacgcccattcggactgctgtgccgcgtcccacgtctcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctactttttatgtgctatgcaaaatagacatctttaacatagtcctgttactatggtaacactttgctttctgaattggaagggaaaaaaaatgtagcgacagcattttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaagtgccttcaaagta

SEQ ID NO: 130130 - DNA, 3222 bp, Homo sapiens
  Payload ID: 5464
  Gene Symbol: EFNB3
  Gene Name: ephrin-B3
  Uniprot ID: Q15768
  ENST ID: ENST00000226091
  CDS Start-End: 398-1420
ggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgctgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcggggtatgccgtcacctcagtagttttactgtaaaagggaaatttgaacaacaaaaaccaaaaaaaataaaaataaaaaacttcaaaagttgacaagaa

SEQ ID NO: 130131 - DNA, 4880 bp, Homo sapiens
  Payload ID: 5465
  Gene Symbol: EGF
  Gene Name: epidermal growth factor
  Uniprot ID: P01133
  ENST ID: ENST00000265171
  CDS Start-End: 446-4069
gaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaa

SEQ ID NO: 130132 - DNA, 3642 bp, Homo sapiens
  Payload ID: 5465
  Gene Symbol: EGF
  Gene Name: epidermal growth factor
  Uniprot ID: P01133
  ENST ID: ENST00000503392
  CDS Start-End: 96-3596
cagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatg

SEQ ID NO: 130133 - DNA, 4489 bp, Homo sapiens
  Payload ID: 5465
  Gene Symbol: EGF
  Gene Name: epidermal growth factor
  Uniprot ID: P01133
  ENST ID: ENST00000509793
  CDS Start-End: 453-3950
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgta

SEQ ID NO: 130134 - DNA, 9821 bp, Homo sapiens
  Payload ID: 5466
  Gene Symbol: EGFR
  Gene Name: epidermal growth factor receptor
  Uniprot ID: P00533
  ENST ID: ENST00000275493
  CDS Start-End: 178-3810
gccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 130135 - DNA, 2239 bp, Homo sapiens
  Payload ID: 5466
  Gene Symbol: EGFR
  Gene Name: epidermal growth factor receptor
  Uniprot ID: P00533
  ENST ID: ENST00000342916
  CDS Start-End: 247-2133
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 130136 - DNA, 2864 bp, Homo sapiens
  Payload ID: 5466
  Gene Symbol: EGFR
  Gene Name: epidermal growth factor receptor
  Uniprot ID: P00533
  ENST ID: ENST00000344576
  CDS Start-End: 246-2363
cccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 130137 - DNA, 5464 bp, Homo sapiens
  Payload ID: 5466
  Gene Symbol: EGFR
  Gene Name: epidermal growth factor receptor
  ENST ID: ENST00000454757
  CDS Start-End: 247-3744
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 130138 - DNA, 2529 bp, Homo sapiens
  Payload ID: 5466
  Gene Symbol: EGFR
  Gene Name: epidermal growth factor receptor
  ENST ID: ENST00000442591
  CDS Start-End: 161-2134
gccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatggaagctacatagtgtctcactttccaagatcattctacaagatgtcagtgcactgaaacatgcaggggcgtgttgagtgccaaggatcttgacaagttgttttgaagatggcattttgctaagtccctgagggtcactggtcctcaaagcggcatggcggcatggcgtggctggttctgccacatgccagctgtgtgacctctgagactccacttcttcagtgctgaaaataaagaaggagttttactaaggaccaaacaagataatgaatgtgaaactgctccacgaaccccaaagaattatgcacatagatgcgatcattaagatgcgaagccatcgagttaccacctggcatgcttaaactgtaaagagtgggtcaaagtaaactgaattggaaaatccaaagttatgcagaaaaacaataaagaggtcttacgtagcaataccgaac

SEQ ID NO: 130139 - DNA, 691 bp, Homo sapiens
  Payload ID: 5466
  Gene Symbol: EGFR
  Gene Name: epidermal growth factor receptor
  ENST ID: ENST00000450046
  CDS Start-End: 308-691
atcattcctttgggcctaggattgcatttatttccatgacaaaagggcctgtctggtgtttcagcaaatgaaaacaaaaatataaagcccatctccttttgaatgagctctaaaacagttctccactggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccag

SEQ ID NO: 130140 - DNA, 1570 bp, Homo sapiens
  Payload ID: 5466
  Gene Symbol: EGFR
  Gene Name: epidermal growth factor receptor
  Uniprot ID: P00533
  ENST ID: ENST00000420316
  CDS Start-End: 245-1462
ccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaa

SEQ ID NO: 130141 - DNA, 3844 bp, Homo sapiens
  Payload ID: 5466
  Gene Symbol: EGFR
  Gene Name: epidermal growth factor receptor
  ENST ID: ENST00000455089
  CDS Start-End: 258-3533
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccaga

SEQ ID NO: 130142 - DNA, 4736 bp, Homo sapiens
  Payload ID: 5467
  Gene Symbol: EPS15
  Gene Name: epidermal growth factor receptor pathway substrate 15
  ENST ID: ENST00000371730
  CDS Start-End: 11-2299
tggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactggcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 130143 - DNA, 5225 bp, Homo sapiens
  Payload ID: 5467
  Gene Symbol: EPS15
  Gene Name: epidermal growth factor receptor pathway substrate 15
  Uniprot ID: P42566
  ENST ID: ENST00000371733
  CDS Start-End: 98-2788
gccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 130144 - DNA, 374 bp, Homo sapiens
  Payload ID: 5467
  Gene Symbol: EPS15
  Gene Name: epidermal growth factor receptor pathway substrate 15
  ENST ID: ENST00000465467
  CDS Start-End: 1-272
ctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaacatgataccagtagtcctttgctaatcagtggaacctctgcagctgagctcccatgggcttgaatggatttctgtctggtgataaagtgaaaccagtgttgctcaactctaagttacctgtggatatccttggaagagtttgggagttgagtgatattgaccatg

SEQ ID NO: 130145 - DNA, 2924 bp, Homo sapiens
  Payload ID: 5468
  Gene Symbol: EPS15L1
  Gene Name: epidermal growth factor receptor pathway substrate 15-like 1
  Uniprot ID: Q9UBC2
  ENST ID: ENST00000248070
  CDS Start-End: 141-2735
acatgcgtggccctgtctacggccccgccctctcccgggacaggcggcctgcgcaccgccctcccgtcgtcccagtgcgcacgcgtggctgcagccccgcccccgttcccccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaaaaagagcc

SEQ ID NO: 130146 - DNA, 3266 bp, Homo sapiens
  Payload ID: 5468
  Gene Symbol: EPS15L1
  Gene Name: epidermal growth factor receptor pathway substrate 15-like 1
  Uniprot ID: Q9UBC2
  ENST ID: ENST00000455140
  CDS Start-End: 68-2800
agtgcgcacgcgtggctgcagccccgcccccgttcccccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccacccgccctcccacgcatcagtcagacactcccccagtggtgtatgcactcgttgtataaaatgaagtttgaatgattaatataaaatattttaatacaaaacaagagaa

SEQ ID NO: 130147 - DNA, 2666 bp, Homo sapiens
  Payload ID: 5468
  Gene Symbol: EPS15L1
  Gene Name: epidermal growth factor receptor pathway substrate 15-like 1
  Uniprot ID: Q9UBC2
  ENST ID: ENST00000535753
  CDS Start-End: 32-2296
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaat

SEQ ID NO: 130148 - DNA, 2788 bp, Homo sapiens
  Payload ID: 5468
  Gene Symbol: EPS15L1
  Gene Name: epidermal growth factor receptor pathway substrate 15-like 1
  ENST ID: ENST00000592031
  CDS Start-End: 26-265
gctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaaaaagagccgc

SEQ ID NO: 130149 - DNA, 420 bp, Homo sapiens
  Payload ID: 5468
  Gene Symbol: EPS15L1
  Gene Name: epidermal growth factor receptor pathway substrate 15-like 1
  ENST ID: ENST00000602151
  CDS Start-End: 1-271
ggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacaggtatatacacatgtacacagagcaaatggaggggctgggcagagcccccaggctgggtgacctccacggctccttccacattcctccactgtcaagtattactaggcatgagcacggctgtcaaacttaacacgggaagttttcattttgaaataaaggtcttttaaacacttggagccatctttcatggctagtgtatcttttattta

SEQ ID NO: 130150 - DNA, 681 bp, Homo sapiens
  Payload ID: 5468
  Gene Symbol: EPS15L1
  Gene Name: epidermal growth factor receptor pathway substrate 15-like 1
  ENST ID: ENST00000594851
  CDS Start-End: 1-215
cgcagactttcccgaggcccccgatccattccagccactcggggctgacagcggcgacccgttccaaatttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccacccgccctcccacgcatcagtcagacactcccccagtggtgtatgcactcgttgtataaaatgaagtttgaatgattaatataaaatattttaatacaaaacaagagaa

SEQ ID NO: 130151 - DNA, 2489 bp, Homo sapiens
  Payload ID: 5468
  Gene Symbol: EPS15L1
  Gene Name: epidermal growth factor receptor pathway substrate 15-like 1
  ENST ID: ENST00000594975
  CDS Start-End: 141-2411
acatgcgtggccctgtctacggccccgccctctcccgggacaggcggcctgcgcaccgccctcccgtcgtcccagtgcgcacgcgtggctgcagccccgcccccgttcccccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaaagtacacctgtaagccagcttggttccgcagactttcccgaggcccccgatccattccagccactcggggctgacagcggcgacccgttcc

SEQ ID NO: 130152 - DNA, 3082 bp, Homo sapiens
  Payload ID: 5468
  Gene Symbol: EPS15L1
  Gene Name: epidermal growth factor receptor pathway substrate 15-like 1
  Uniprot ID: Q9UBC2
  ENST ID: ENST00000602022
  CDS Start-End: 17-2281
ccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccacccgccctcccacgcatcagtcagacactcccccagtggtgtatgcactcgttgtataaaatgaagtttgaatgattaatataaaatattttaatacaaaacaagagaa

SEQ ID NO: 130153 - DNA, 629 bp, Homo sapiens
  Payload ID: 5468
  Gene Symbol: EPS15L1
  Gene Name: epidermal growth factor receptor pathway substrate 15-like 1
  ENST ID: ENST00000596037
  CDS Start-End: 7-339
gggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcaaacccacccacctatgatttaattctgtgccagccacaaaggaatgtttctctctcttctcagcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtg

SEQ ID NO: 130154 - DNA, 3486 bp, Homo sapiens
  Payload ID: 5468
  Gene Symbol: EPS15L1
  Gene Name: epidermal growth factor receptor pathway substrate 15-like 1
  Uniprot ID: Q9UBC2
  ENST ID: ENST00000597937
  CDS Start-End: 6-1811
ggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggttgaataaacgtattacagtatggggctctggtcccctggtgtgacagcagaacatcccacccgccagatctgttcatggccaacgttggttccagccaagtgcaggcggctgtctgttgtttttgctgccactttgcgcgttcacaccaggccttgcagcctggcacaggtggccatgctgaatcctggcttccagaacaaagtccaagataggcctggatcctttcagaacctgttttgaatgccctccatctctgcggaagtatttacattgggccaaccacccaagttcagagggcttctcaaacttaaccaaaattggatcagtttctgctcattgtggaaaccccacattctactaatcagggggcaggggacatctgaggggcatgtgtctatgtgtatgtgtgtttccacaaggaacaccttgaaaagcaaatgtgttgctaaagatgaggaagtaatggcaagcagcgccccagggtgttgctctttcaagtaagaattggcctctcctgaaattttggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgctgccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagcatt

SEQ ID NO: 130155 - DNA, 3915 bp, Homo sapiens
  Payload ID: 5468
  Gene Symbol: EPS15L1
  Gene Name: epidermal growth factor receptor pathway substrate 15-like 1
  ENST ID: ENST00000602009
  CDS Start-End: 897-2240
cgtattaatttatttaccattagaaatggagggcttcctgtatgtggctgggcttggtggctcacacctgtaatcccagcactttgggaggccgaggcaggcggatcacttgaggccaggagttcaagaccaacccggccatcatgttgaaacaccatctctacaaaaaatacaaaaattagccgggcctggtggcgcatgcctgtgatcccagctactcgggaggtacgagtgctgaggcacgagaattgcttgaacctgggagtcggaagttgcagtgagctgagattgtgccactacactccagcctgggcaacagagcaagatttttgtctcaaaaaaagaaaaaaaaaaaaaaaaagaggacttcctgtactttaagttgattttgataattatttgctcaagcactaacatctgctcacacttttgtctttctggtacaagtgggctccttggaggcaggtgagactgatctttgtctccctgcaaagacactgccccaccatgggagactcctgccacactcaggcagcagctaggacgaaggacaagacccggggccagggcctccctcctgaggaccttggctcccagatccgaggttgccataacgttatttccttcagggtatatgttcactttggaaaccaaggggccaagactgttctaagatcattttgtgcttttagccaagggtgatgatgggtccgtggccattttcacttggctttcggtcagagctcggtctggacattcacacaggtgtgctctcctacttactcgggctatttctttccaactaggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggttgaataaacgtattacagtatggggctctggtcccctggtgtgacagcagaacatcccacccgccagatctgttcatggccaacgttggttccagccaagtgcaggcggctgtctgttgtttttgctgccactttgcgcgttcacaccaggccttgcagcctggcacaggtggccatgctgaatcctggcttccagaacaaagtccaagataggcctggatcctttcagaacctgttttgaatgccctccatctctgcggaagtatttacattgggccaaccacccaagttcagagggcttctcaaacttaaccaaaattggatcagtttctgctcattgtggaaaccccacattctactaatcagggggcaggggacatctgaggggcatgtgtctatgtgtatgtgtgtttccacaaggaacaccttgaaaagcaaatgtgttgctaaagatgaggaagtaatggcaagcagcgccccagggtgttgctctttcaagtaagaattggcctctcctgaaattttggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgctgccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagcatt

SEQ ID NO: 130156 - DNA, 583 bp, Homo sapiens
  Payload ID: 5468
  Gene Symbol: EPS15L1
  Gene Name: epidermal growth factor receptor pathway substrate 15-like 1
  ENST ID: ENST00000593760
  CDS Start-End: 15-266
gagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaag

SEQ ID NO: 130157 - DNA, 1921 bp, Homo sapiens
  Payload ID: 5468
  Gene Symbol: EPS15L1
  Gene Name: epidermal growth factor receptor pathway substrate 15-like 1
  ENST ID: ENST00000599790
  CDS Start-End: 1-640
cgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggaatgaaggaaagcagatgaggtgtgtcccgtccctgacacctgcgtccactctgtcccttctcggcagcccccaggcaggggcagatgggctctgtcttcggggggctgcaggggcctgctttcctcacgagttccacctgcagaggcccaggcattatccacgctgcgggaagaggcagtagccacaagcagaacacagcccccctcctggagcccatggcccaggtggtaaggggtggccggtgtggggggtcccctggagcagctgggcccagtccctgtgagcgctgctgtcagcctgaaggtggtgaggggagggagccccgggagtacctggaagacgcgtgccccaggcatgaggccccctcggggccccaccggccccatgcccaggtgccccaggtgccagtgtgactgggcagtctcccttggctgccccgtgttcactcagctggtggagcagatgagtctctgagcatcttggggttggcagcggtcgcaacttgtgatcacagaacacagattccgagaagcacttgagattctgttcaggttttcaaagacgcgtgtgtgcgtgccctggcggcgcagcagatcccacttctgaccgaggcagggtgtgtgtttacacagatgagcctgggcagagggagcccagaggccctggcatggcgcccccctccttccagcacacggagaaggcctccatccctcatatgccacgctgtgacacggtttgggactggcagaagatttagggcccagtgcacaggctcctgggcaggcgggaaaccatctcccgaaagcagaaaacgttggccacacggtggcagcagtccctcaggcgtcctggtcgtttctggttgtcgcaagtggactcctcttcctttgggaggctggatctgtcttcctcctctcactgtgagcagagggagggagagctagcagagcctgagctagggccgggatctaatgaccgccctctgcctgtccttgggccctgaaaccaggggctcttcacacacatgcagctgtgatttcagagccggtctcacttcctattggcggtgccgggccaggacagagttggacagagctgtggaaaatgggtctccaatactatcttgttttgattccagcgttccatcagctgccttcatgacacttgtacagccgcattctgagctcaaccctgaccttgcagctctgtttttcctttttggttacctatctgtttttcaagaacaacattgtggatataaataaaatgctaagggaaatgaaa

SEQ ID NO: 130158 - DNA, 4061 bp, Homo sapiens
  Payload ID: 5469
  Gene Symbol: EPS8
  Gene Name: epidermal growth factor receptor pathway substrate 8
  Uniprot ID: Q12929
  ENST ID: ENST00000281172
  CDS Start-End: 438-2906
cacttcgcctcaagcgctggagtcgaccagaactctgcggctcggctgccggcaagacccggatagcggatttcgctcctggctgcggggcgcgcactcgcccgcccgcccgctcgctcgttcctcgcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaa

SEQ ID NO: 130159 - DNA, 1858 bp, Homo sapiens
  Payload ID: 5469
  Gene Symbol: EPS8
  Gene Name: epidermal growth factor receptor pathway substrate 8
  Uniprot ID: Q12929
  ENST ID: ENST00000542903
  CDS Start-End: 127-1815
agtattgacaaggatgcatttcatggctgatgagcacagttttgacttgtgtatccagtggaggtgttccctttggcaaatgttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattc

SEQ ID NO: 130160 - DNA, 655 bp, Homo sapiens
  Payload ID: 5469
  Gene Symbol: EPS8
  Gene Name: epidermal growth factor receptor pathway substrate 8
  ENST ID: ENST00000546261
  CDS Start-End: 1-205
agatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactagtccctttttggacaagtttgtcatattcatggaaaggttgtcaggacagtggttggctgctggcagtggagaagggtaaaagttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtg

SEQ ID NO: 130161 - DNA, 559 bp, Homo sapiens
  Payload ID: 5469
  Gene Symbol: EPS8
  Gene Name: epidermal growth factor receptor pathway substrate 8
  ENST ID: ENST00000536793
  CDS Start-End: 356-559
agacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgaggacggtcagtaaaatcttcccctgaggacattgtgattgaactgagatctgaagaatgagacagaattaactcgaagtgaccagatcttgaatattatttctttataacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaa

SEQ ID NO: 130162 - DNA, 543 bp, Homo sapiens
  Payload ID: 5469
  Gene Symbol: EPS8
  Gene Name: epidermal growth factor receptor pathway substrate 8
  ENST ID: ENST00000535752
  CDS Start-End: 182-543
gtagaagtgacttgaagaaagagcgagaagtatagaagggcgcaggcgctagttcagtgctcgtgagcaaacaccgtctacaagattcgagtcaaacaacgtgagaacttgaaatacgtctccattctttttccttagtactctcgttcattcacttacgaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatc

SEQ ID NO: 130163 - DNA, 3925 bp, Homo sapiens
  Payload ID: 5469
  Gene Symbol: EPS8
  Gene Name: epidermal growth factor receptor pathway substrate 8
  Uniprot ID: Q12929
  ENST ID: ENST00000543523
  CDS Start-End: 298-2766
agacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagctccttgggttctggaaagtgagcactagtaatggacgtcatgtggtaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaataaa

SEQ ID NO: 130164 - DNA, 2204 bp, Homo sapiens
  Payload ID: 5469
  Gene Symbol: EPS8
  Gene Name: epidermal growth factor receptor pathway substrate 8
  Uniprot ID: Q12929
  ENST ID: ENST00000540613
  CDS Start-End: 402-2090
aataccctgaatggtcttaagacatttattttttaatgtgaaaatttctgtctgcttttaaagcatgtagcttaaaattaatgagcccaacattgtgggttttaagcttaattacactagaattttaagaagcactctgctgtcagaactccgaaagctttattgtagtcacagtgttggaatgtataaaaattatagctctgttgcattagaacttagttgaccagcttttgagaagtaaaagcttgactgctggtttatatttctggcttgtgtaggaattaaagggtgctaagttaaggttggttctacaggtagctgactcagggaagagagagaatggggtgatattacaagttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccat

SEQ ID NO: 130165 - DNA, 2965 bp, Homo sapiens
  Payload ID: 5469
  Gene Symbol: EPS8
  Gene Name: epidermal growth factor receptor pathway substrate 8
  Uniprot ID: Q12929
  ENST ID: ENST00000543612
  CDS Start-End: 163-2631
acaatgccgaaactgacgcttagagtcccaccctttctgacgttgtgccaaaggtcacttggcacataagtaaactgagtggaatggcctctcaatattgcctggacgattgcttagaggagtatttcctgaactgtgtggaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaa

SEQ ID NO: 130166 - DNA, 621 bp, Homo sapiens
  Payload ID: 5469
  Gene Symbol: EPS8
  Gene Name: epidermal growth factor receptor pathway substrate 8
  ENST ID: ENST00000536956
  CDS Start-End: 262-387
gcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaaaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatga

SEQ ID NO: 130167 - DNA, 374 bp, Homo sapiens
  Payload ID: 5469
  Gene Symbol: EPS8
  Gene Name: epidermal growth factor receptor pathway substrate 8
  ENST ID: ENST00000543363
  CDS Start-End: 171-374
agaaggctcagagaatggaggcagccagacacccgttttagtacagtgtggagctgaaggaagtatatattaaaaaacaaacaaacaatggactttggaatcagaccttatctgccttggttttcttatcaaagaggtggaaatgtcaaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaa

SEQ ID NO: 130168 - DNA, 542 bp, Homo sapiens
  Payload ID: 5469
  Gene Symbol: EPS8
  Gene Name: epidermal growth factor receptor pathway substrate 8
  ENST ID: ENST00000546311
  CDS Start-End: 159-542
attgccatggtgatgaataatctgctgagttttatggttggcatgattcttctggattaggtcacttgtgttttctttctataataccagtcgactacgcttttggtaacagttaaagttccatcactaaaaagctaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaatttt

SEQ ID NO: 130169 - DNA, 577 bp, Homo sapiens
  Payload ID: 5469
  Gene Symbol: EPS8
  Gene Name: epidermal growth factor receptor pathway substrate 8
  ENST ID: ENST00000544064
  CDS Start-End: 377-577
acaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgaggacggtcagtaaaatcttcccctgaggacattgtgattgaactgagatctgaagaatgagacagaattaactcgaagtgaccagatcttgaatattatttctttatgtaggctttctgtgctcttccaatcagaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgtt

SEQ ID NO: 130170 - DNA, 3722 bp, Homo sapiens
  Payload ID: 5469
  Gene Symbol: EPS8
  Gene Name: epidermal growth factor receptor pathway substrate 8
  ENST ID: ENST00000543468
  CDS Start-End: 232-834
ctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgagttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaataaa

SEQ ID NO: 130171 - DNA, 1217 bp, Homo sapiens
  Payload ID: 5470
  Gene Symbol: EPPIN
  Gene Name: epididymal peptidase inhibitor
  Uniprot ID: O95925
  ENST ID: ENST00000336443
  CDS Start-End: 565-918
acagatgatgaaaccaaggttcagagagggtcagaattcagaccaagtcagaattcaaaatctaaactggctccggggtaagtgatactaattgctgtataatactaccacctagaggaacttccaaacatggattcctcaacaaggccaaaaagaccgcattggcttacatcagtggcccacaatggtgtgattttgccttccaggggacctttgcagtgcctggagacattttcagttgttacaatcaggggtgctactggattctgatgggaagaggcctgggatgctgctaaacatcctacaatccccagttcagccccccaaacaaagaattatccagcccaaatatcaccagtggttgagaaattctgccttagatgggatggagctggggggtgggaatagagggaggagaggtcactggggagtggtgggggtgtaggcagtagggaaatgagtgaggctgccctgaggaaaagaactcctgggggcaagcaaactgaaagcaaacttccctgactctctagaattgccttgtgtctggcaaagtggggagacactatgctctctaaggcacacgggtgtaaaaccgctctttccctagggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagt

SEQ ID NO: 130172 - DNA, 1987 bp, Homo sapiens
  Payload ID: 5470
  Gene Symbol: EPPIN
  Gene Name: epididymal peptidase inhibitor
  Uniprot ID: O95925
  ENST ID: ENST00000354280
  CDS Start-End: 68-469
tatccaaggtgcagcagctgagcattccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtcctgtgccttgaggctgagtgattgacatctttttggcacattacactttgcagagtaagggatcattgaggcttctggtgacatcattcaagggagtgaagacaatcagaactttgagagttcagagttccaggaatattgttattgttatcttcctctgtttctacaaaagattgtaaaaccctttttaggcaagggcccaaggacagtgccttagtttggatcctctagaaactaaccctgggaaaagggcatgggtgcaggtagtttgtttgagagatttcccaggacatacaagatggggagtgagatgagtaattcagggaagagaagggaagagagaagagtctattatgagctggttactactgtggctcaatcctattggggaccttttaaagaatcatgtaaaacaggcttacaaattttctttttaaaaatattttattttattttacgttccgggatacatgtgcaggacctgcaggtttgttacataggtaagcctgtgccatggtggtttgctgcacctatcaacccattacctgggtattaagccccgcatgcattagctatttatcctgatgctttccctccccctgccccctcaacagtccacgtgttctcattgttcatctcccacttgcaagtgagaacatgtggtatttacttttgttcctgcgttactttgctgaggataacggcttccagcttcatccatgtccctgcaaaggacgtgatctcatttctttttatggctgcatagtattccatggcatatatgtaccacattttctttatccagcctatcgttgatggatatttggtttgattccatgtttttgctattgtaaatagtgctgcagtgaacatacacatgcatgtatctttataaaagaatgatttatattcctttgagtgtatacccagtaatgggattgctgggtcaaatggtatttctggttctagatctttcaggaattggcacactctcttccacaatggttgaaccaatttacattcccaacagtgtaaaagcattcatgtttctccacagctttaccagcatctgttgtttctggactttttaataatcaccattctgactggcatgagatggtatctcattgtggttttgatttgcatttctctgatgatcactggtgttgagctttttttcatatgtttgttggccgcataaatgtcttcttttgagaa

SEQ ID NO: 130173 - DNA, 998 bp, Homo sapiens
  Payload ID: 5470
  Gene Symbol: EPPIN
  Gene Name: epididymal peptidase inhibitor
  ENST ID: ENST00000409554
  CDS Start-End: 396-629
gtgtgctagtaagtgtgcacgtacgatggaaaatgaatgaagaatgaggacattccaccactctccaagttatcaagatgaagacccaagatggtggcattcactctgaaggtagcctggaaagtgggagacacgctttgcccactccctgtggttgactagagcccccagcccagtgcagcctaggggtgtaaggatcaagatccattcaataagagacccttcctcccaagctgtgagctgtgggtgccagttagtcccatttgtgaccttgggaacttagtgttcccagcaagaaagggggtggctggcttgtctccagttcttatatccaaggtgcagcagctgagcattccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagggaaacaataacaacttccaatccaaagccaactgcctgaacacctgcaagaataaacgctttccctgattggataaggatgcactggaagaactgccagaatgtggctcatgctctgagtactgttcctgtacctgacggatgctccagactggcttccagtttcactctcagcattccaagatcttagcccttcccagaacagaacgcttgcatctacctcctcttcctccatctttggctcttttgatgcacaatatccatccgttttgatttcatctttatgtcccctttatctccaacttctagaactcccagtttatacctgtgtcactctcaattttttccagtaaagtacttgatgtagtcctgtgccttga

SEQ ID NO: 130174 - DNA, 927 bp, Homo sapiens
  Payload ID: 5471
  Gene Symbol: EDDM3A
  Gene Name: epididymal protein 3A
  Uniprot ID: Q14507
  ENST ID: ENST00000326842
  CDS Start-End: 128-571
tccagggctctgagaaaaggaggaggacgcagactctgctcttcagatccacatgctgatccccactacaatcagtgacctgaactcagagtccaagtaggacacgcaggtggacgtggtgactgagatgacatcctctctaaagatttggggcatactcttggccctgctttgcatcctttgcaggctgtgtgtatacagtaacaacatttactggagagaattcataaaacttcattacttaagtccaagtcgagaattcaaagagtacaaatgtgatgtcctcatgagagaaaaagaggctctgaaaggcaagagctttcatatgttcatctatagcttatggttcaaaattcagcgtgcatgcatcaatgagaaggggagcgaccgatatagaaatgcatatgtatgggccccaggtgccctcaaagtactcgagtgtcactgggagaagtacaacaataggtacacagagagcagaagcttcagctacattgaattccattgtggcgtagatggatatgttgataacatagaagacctgaggattatagaacctatcagcaactagaaagtctatgcacatcctcagatattggtagagtattcagtgcttccaaagtggtgggccctgcctccatcaatagcccctgccactccccgcttacatttatgtgtcagtgttttccaactacttagagtttatgtacctcgtgatttcttgataccaaatctttgtgtggtttctgtatctgtaatacaattttgtcctaatttgcctaatttacacccacattttttccaagattcagctcatatggcatctgtcctcgactaacctaagactttcctgatattgactctctttatacctacccaagctgaacgaccctccttttcttaaataaaatatattattctaacgta

SEQ ID NO: 130175 - DNA, 584 bp, Homo sapiens
  Payload ID: 5471
  Gene Symbol: EDDM3A
  Gene Name: epididymal protein 3A
  ENST ID: ENST00000618864
  CDS Start-End: 62-505
aaccccactataaccagtgacctgaactcagagtctgagtagggtgtccctggtgactgaaatggcatcctctctgaagatctggggcagtcccttggccctgctttgcattctttgcaggctacttgtacacagcaaggacgtttcctggagagaattcataaaacttcattacttaagtccaagtcgagaattcaaagagtacaaatgtgatgtcctcatgagagaaaaagaggctctgaaaggcaagagctttcatatgttcatctatagcttatggttcaaaattcagcgtgcatgcatcaatgagaaggggagcgaccgatatagaaatgcatatgtatgggccccaggtgccctcaaagtactcgagtgtcactgggagaagtacaacaataggtacacagagagcagaagcttcagctacattgaattccattgtggcgtagatggatatgttgataacatagaagacctgaggattatagaacctatcagcaactagaaagtctatgcacatcctcagatattggtagagtattcagtgcttccaaagtggtgggccctgcctccatcaatagccc

SEQ ID NO: 130176 - DNA, 896 bp, Homo sapiens
  Payload ID: 5472
  Gene Symbol: EDDM3B
  Gene Name: epididymal protein 3B
  Uniprot ID: P56851
  ENST ID: ENST00000326783
  CDS Start-End: 99-542
ggaggactcagactctgctcttcagatccacacactgatcccaactacaaccagtgacctgaacttggagtctgagtagggcggccccggtgactgagatggcatcgtctctaaagatctggggcacactcttggccctactttgcatcctatgcacactgcttgtacagagcaaagaagtttcttggagagaattcatgaaacagcactacttaagtccaagtcgagaattcagagagtacaaatgtgatgtcctcatgagagaaaatgaagctctgaaagacaagagctctcacatgtttatctatatctcatggtacaaaatcgagcatatatgcactagtgacaactggatggatcgcttccgaaatgcatatgtatgggtccagaatcctctcaaagtactcaagtgtcaccaggagaattccaaaaatagctacacagagagcaggagcttcaactacattgaattccattgtagcatggacgggtatgttgatagcatagaagacctaaagatggtagaacctatcggcaactagaaagtctatgcacatcctcaggtattggtagagtattcagtgctttctaagtagcagcccctgcctccatcaatagtcctaccactcccctcttgcatttatttgtcaatgttttccaaatacttagagttatgaatagcataatttcttgataccataactttgcctgtgttgtttctctgcctggaatacacttttgtcttcatttacctaatttactcttatacttttgtcgacattcagctcatatggcatctgttcttgattaacccaagactttcctgatattgactctcttgatacatacccaagctgaacaatcttcccttccctaaataaattatatgactgcaa

SEQ ID NO: 130177 - DNA, 1052 bp, Homo sapiens
  Payload ID: 5473
  Gene Symbol: ELSPBP1
  Gene Name: epididymal sperm binding protein 1
  Uniprot ID: Q96BH3
  ENST ID: ENST00000339841
  CDS Start-End: 179-850
cactgatgaagaaccctcctttgagaagctgcctttgtgtcctacagacaggctggggccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggagggatgcatgaggaatgtgtctttcctttcacctacaagggatctgtttacttcacttgcacccatattcatagcttatccccttggtgtgccaccagagccgtgtacaacggccagtggaagtactgccagagtgaagattacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacgaaggatcaaaggagaaccttgtgtggtgtgcaacttcttacaactacgaccaagaccacacctgggtgtattgctgatgctgaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgattt

SEQ ID NO: 130178 - DNA, 456 bp, Homo sapiens
  Payload ID: 5473
  Gene Symbol: ELSPBP1
  Gene Name: epididymal sperm binding protein 1
  ENST ID: ENST00000593413
  CDS Start-End: 1-231
agcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacgaaggatcaaaggagaaccttgtgtggtgtgcaacttcttacaactacgaccaagaccacacctgggtgtattgctgatgctgagatctttgcttctattttcaaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgatttaa

SEQ ID NO: 130179 - DNA, 574 bp, Homo sapiens
  Payload ID: 5473
  Gene Symbol: ELSPBP1
  Gene Name: epididymal sperm binding protein 1
  ENST ID: ENST00000596043
  CDS Start-End: 125-574
ggggccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggagattacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgc

SEQ ID NO: 130180 - DNA, 557 bp, Homo sapiens
  Payload ID: 5473
  Gene Symbol: ELSPBP1
  Gene Name: epididymal sperm binding protein 1
  ENST ID: ENST00000597519
  CDS Start-End: 121-348
ccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggaggaatttccgcgttggtccctggctttccttgtcactttccgttcaactataaaaacaagaattattttaactgcactaacgaaggatcaaaggagaaccttgtgtggtgtgcaacttcttacaactacgaccaagaccacacctgggtgtattgctgatgctgaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgatttaaccctg

SEQ ID NO: 130181 - DNA, 696 bp, Homo sapiens
  Payload ID: 5473
  Gene Symbol: ELSPBP1
  Gene Name: epididymal sperm binding protein 1
  ENST ID: ENST00000593782
  CDS Start-End: 1-464
attacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacgaaggatcaaaggagaaccttgtgtggtgtgcaacttcttacaactacgaccaagaccacacctgggtgtattgctgatgctgaggtgagagcagggaccaacagtggtcatttcacggatgcagaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaag

SEQ ID NO: 130182 - DNA, 893 bp, Homo sapiens
  Payload ID: 5473
  Gene Symbol: ELSPBP1
  Gene Name: epididymal sperm binding protein 1
  ENST ID: ENST00000619003
  CDS Start-End: 28-690
agagaagagggcagccaagatgacccgatggtccagttacctgttggatggacaaccttccttctctattcctatgagtcaagtggagggatgcatgaggaatgtgtctttcctttcacctacaagggatctgtttacttcacttgcacccatattcatagcttatccccttggtgtgccaccagagccgtgtacaacggccagtggaagtactgccagagtgaagattacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacgaaggatcaaaggagaaccttgtgtggtgtgcaacttcttacaactacgaccaagaccacacctgggtgtattgctgatgctgaggtgaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttg

SEQ ID NO: 130183 - DNA, 3633 bp, Homo sapiens
  Payload ID: 5474
  Gene Symbol: EPM2A
  Gene Name: epilepsy, progressive myoclonus type 2A, Lafora disease (laforin)
  Uniprot ID: O95278
  ENST ID: ENST00000367519
  CDS Start-End: 527-1522
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccggccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaaga

SEQ ID NO: 130184 - DNA, 1037 bp, Homo sapiens
  Payload ID: 5474
  Gene Symbol: EPM2A
  Gene Name: epilepsy, progressive myoclonus type 2A, Lafora disease (laforin)
  ENST ID: ENST00000435470
  CDS Start-End: 1-713
tggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaat

SEQ ID NO: 130185 - DNA, 736 bp, Homo sapiens
  Payload ID: 5474
  Gene Symbol: EPM2A
  Gene Name: epilepsy, progressive myoclonus type 2A, Lafora disease (laforin)
  ENST ID: ENST00000450221
  CDS Start-End: 1-512
gcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaagatgagaagaggacagctgacatgtgctgctcggggatgtgggaagagactgcagattttggccttgggattctggattacttaaaacaaaagtaagacacaaatatctccctaaccttattatatctcgtagaagatggcagatgggtgacgactggtgcaagctcacacaggaaagaaaaatttcataagcattgaatagttgtgttactaattagtgggacaatcttcgtaactccttcttcccccacttctgcccaatatgtaataataggcatgctctgaataattgtactcaaataagaaattactcctccaaa

SEQ ID NO: 130186 - DNA, 3641 bp, Homo sapiens
  Payload ID: 5474
  Gene Symbol: EPM2A
  Gene Name: epilepsy, progressive myoclonus type 2A, Lafora disease (laforin)
  Uniprot ID: O95278
  ENST ID: ENST00000611340
  CDS Start-End: 956-1537
taatgctcatgtgtttgagatgtgagagtgaatgtgtttgagatatgagaatgaattgtgaatgaatgagagtgaatgctcatgtgtttgagatgtgagaatgaattgtgcttgcagaaagccagtaaacagatagttcaatgagataagagctgtcttaggagattgtacctttttctgaaagagctgtggtaaggctgacaggtcaagattgactgactggctgggccttcaccaggtgtgagaagtcttagtaccattgttggtcccaggacttctcttccagtaagctcattaaaatgttttatttttccaacaccatcaccaatttgagtttcattatctggaatatcttctaagttttttgctctgatgctggcatcctgggcaaagtccagatagctcaggcctgtagtgccgccagtacatacaggagtgagaagcccaacagtttcaattccgtgatctttatggttttaaatggtaaattgtaatgccacatgaatgtagcgttttatcctgaattttagctaagtaaaacttcagagaattaagggaatgatttttttctcttttttatttgacagggtctggctctgtcacccaggctggagtacagtggcatgatcttggctcactgcagcctctgcctcccaggctcaagccatcctcccatgtcaaccttctgagtagctgaaaccacaggcatgtttcaccatggccagctaatttttgtattttttagtagaaatggggtttcgccatgttgcccaggcctgtctcgaactcctgaagcacaagtgatccacctgcctaggtgacccaaagtaatgggattacaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcattt

SEQ ID NO: 130187 - DNA, 1694 bp, Homo sapiens
  Payload ID: 5474
  Gene Symbol: EPM2A
  Gene Name: epilepsy, progressive myoclonus type 2A, Lafora disease (laforin)
  Uniprot ID: O95278
  ENST ID: ENST00000618445
  CDS Start-End: 358-1311
gagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccggccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcattt

SEQ ID NO: 130188 - DNA, 1539 bp, Homo sapiens
  Payload ID: 5475
  Gene Symbol: EPYC
  Gene Name: epiphycan
  Uniprot ID: Q99645
  ENST ID: ENST00000261172
  CDS Start-End: 94-1062
acagccattggtcaggggcaaataccactagctctgcatcctcagtcactttgtgccatttcatcaggtcagagccaaaggaaagcttgaaaaatgaagacattagcaggacttgttctgggacttgtcatctttgatgctgctgtgactgccccaactctagagtccatcaactatgactcagaaacctatgatgccaccttagaagacctggataatttgtacaactatgaaaacatacctgttgataaagttgagattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtcttttgtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtgatttaaaaaggattgatctgacatcaaatttaatatctgagattgatgaagatgcattccgaaaactgcctcaacttcgagagcttgtcctgcgtgacaacaaaataaggcagctcccagaattgccaaccactttgacatttattgatattagcaacaatagacttggaaggaaagggataaagcaagaagcatttaaagacatgtatgatctccatcatctgtacctcactgataacaacttggaccacatccctctgccactcccagaaaatctacgagcccttcacctccagaataacaacattctggaaatgcacgaagatacgttctgcaatgttaaaaatttgacttatattcgtaaggcactagaggacattcgattggatggaaaccctattaatctcagcaaaactcctcaagcatacatgtgtctacctcgtctgcctgttgggagccttgtctaatttcagataatggttagcattacgatggctactataaataaaccattcttactgctctcttccaaaacaaaactcagcatgatactttgagattgtgttctgagagatgatatgactacataaaatacaattaaaaatgttataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaagcatgtttattcccctaatccattaaagagcatgaaaaaaagaataaatgtatttgaaaattataa

SEQ ID NO: 130189 - DNA, 790 bp, Homo sapiens
  Payload ID: 5475
  Gene Symbol: EPYC
  Gene Name: epiphycan
  ENST ID: ENST00000551767
  CDS Start-End: 89-790
acagccattggtcaggggcaaataccactagctctgcatcctcagtcactttgtgccatttcatcaggtcagagccaaagcttgaaaaatgaagacattagcaggacttgttctgggacttgtcatctttgatgctgctgtgactgccccaactctagagtccatcaactatgactcagaaacctatgatgccaccttagaagacctggataatttgtacaactatgaaaacatacctgttgataaagttgagattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtcttttgtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtgatttaaaaaggattgatctgacatcaaatttaatatctgagattgatgaagatgcattccgaaaactgcctcaacttcgagagcttgtcctgcgtgacaacaaaataaggcagctcccagaattgccaaccactttgacatttattgatattagcaacaatagacttggaaggaaagggataaagcaagaagcatttaaa

SEQ ID NO: 130190 - DNA, 15530 bp, Homo sapiens
  Payload ID: 5476
  Gene Symbol: EPPK1
  Gene Name: epiplakin 1
  ENST ID: ENST00000568225
  CDS Start-End: 89-15280
ccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcgaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggccgagcaggccgtgacagggcaccacgaccccttcagtggctcccaaatcccccttttccaggccatgaagaaggggctagtggacaggccactggcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctaagctgagcgccaccctcgagcaggctgcagccactgccagggtcaccttttctgggctgagggacaccgtgacaccaggagagctgctgaaagccgagatcatcgaccaggacctgtacgagcggctggagcatggacaggccacagccaaggatgtgggcagcctggcctcggtgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgaaaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagctcctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccaccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagaccgaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccagcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaagagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggtgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccaccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggcccaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgatgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgtttttttttttttttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctc

SEQ ID NO: 130191 - DNA, 16002 bp, Homo sapiens
  Payload ID: 5476
  Gene Symbol: EPPK1
  Gene Name: epiplakin 1
  ENST ID: ENST00000615648
  CDS Start-End: 73-15339
actgcggaccgagcggcgagcgggcaggacagaggtggacctcagcaggctctgcataaccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcgaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggccgagcaggccgtgacagggcaccacgaccccttcagtggctcccaaatcccccttttccaggccatgaagaaggggctagtggacaggccactggcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctaagctgagcgccaccctcgagcaggctgcagccactgccagggtcaccttttctgggctgagggacaccgtgacaccaggagagctgctgaaagccgagatcatcgaccaggacctgtacgagcggctggagcatggacaggccacagccaaggatgtgggcagcctggcctcggtgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgaaaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagctcctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccaccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagaccgaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccagcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaagagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggtgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccaccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggcccaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgatgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgtttttttttttttttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactgagcgagtctgttgtggagaagaactttttgtagtaatttactaggaaaaattctgaacaagtaaaatatgaaggaaa

SEQ ID NO: 130192 - DNA, 4619 bp, Homo sapiens
  Payload ID: 5477
  Gene Symbol: EREG
  Gene Name: epiregulin
  Uniprot ID: O14944
  ENST ID: ENST00000244869
  CDS Start-End: 167-676
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagaatatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattcccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcatatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatacagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggtgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcatctcaatcttggtttgtcagtttatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttgaagtaacttatttgactatgaatgttatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatc

SEQ ID NO: 130193 - DNA, 1724 bp, Homo sapiens
  Payload ID: 5478
  Gene Symbol: EPCAM
  Gene Name: epithelial cell adhesion molecule
  Uniprot ID: P16422
  ENST ID: ENST00000263735
  CDS Start-End: 359-1303
aactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttga

SEQ ID NO: 130194 - DNA, 1530 bp, Homo sapiens
  Payload ID: 5478
  Gene Symbol: EPCAM
  Gene Name: epithelial cell adhesion molecule
  ENST ID: ENST00000405271
  CDS Start-End: 215-1243
cttggggacaaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaa

SEQ ID NO: 130195 - DNA, 609 bp, Homo sapiens
  Payload ID: 5478
  Gene Symbol: EPCAM
  Gene Name: epithelial cell adhesion molecule
  ENST ID: ENST00000419334
  CDS Start-End: 12-609
gcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctgggg

SEQ ID NO: 130196 - DNA, 1501 bp, Homo sapiens
  Payload ID: 5478
  Gene Symbol: EPCAM
  Gene Name: epithelial cell adhesion molecule
  ENST ID: ENST00000456133
  CDS Start-End: 210-1238
ggacaaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtttctttttcttttttcttttctttttttcttttttttttttt

SEQ ID NO: 130197 - DNA, 4087 bp, Homo sapiens
  Payload ID: 5479
  Gene Symbol: ECT2
  Gene Name: epithelial cell transforming 2
  Uniprot ID: Q9H8V3
  ENST ID: ENST00000232458
  CDS Start-End: 199-2850
tctggagactcctgcctatgggaaagaggttgacatcacgcgccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 130198 - DNA, 4158 bp, Homo sapiens
  Payload ID: 5479
  Gene Symbol: ECT2
  Gene Name: epithelial cell transforming 2
  Uniprot ID: Q9H8V3
  ENST ID: ENST00000392692
  CDS Start-End: 177-2921
aaagaggttgacatcacgcgccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaaaaattaataaaaagtgttattaatatggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 130199 - DNA, 573 bp, Homo sapiens
  Payload ID: 5479
  Gene Symbol: ECT2
  Gene Name: epithelial cell transforming 2
  ENST ID: ENST00000438041
  CDS Start-End: 123-573
acccccagcagccgggccctgacgcggagtgggagaccgaagcccccagtattgctgggcatcttcgccctcacctgttggctcttttggacagaagagtctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaaaaattaataaaaagtgttattaatatggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggac

SEQ ID NO: 130200 - DNA, 558 bp, Homo sapiens
  Payload ID: 5479
  Gene Symbol: ECT2
  Gene Name: epithelial cell transforming 2
  ENST ID: ENST00000366254
  CDS Start-End: 504-558
aattccggagcgccccagctcaggcttcccggatccgggaactccctcgccgcaccccacccccagcagccgggccctgacgcggagtgggagaccgaagcccccagtattgctgggcatcttcgccctcacctgttggctcttttggacagaagagtacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatcatggctgaaaatagtgtattaacatccactactgggaggactagcttggcagact

SEQ ID NO: 130201 - DNA, 2266 bp, Homo sapiens
  Payload ID: 5479
  Gene Symbol: ECT2
  Gene Name: epithelial cell transforming 2
  ENST ID: ENST00000437296
  CDS Start-End: 1-895
cccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattaggagatttgccaaccactaatggaaacaagcctcatgaagtttaatggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 130202 - DNA, 734 bp, Homo sapiens
  Payload ID: 5479
  Gene Symbol: ECT2
  Gene Name: epithelial cell transforming 2
  ENST ID: ENST00000366090
  CDS Start-End: 405-734
gaatcggttgtggcggccgccggcgaggaatggcggtatttgtgagaggagtcggcgtttgaagaggtggaactcctagggcttttttgagagtgacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaaaaattaataaaaagtgttattaatatggacattaaagtgggctttgtaaagatg

SEQ ID NO: 130203 - DNA, 735 bp, Homo sapiens
  Payload ID: 5479
  Gene Symbol: ECT2
  Gene Name: epithelial cell transforming 2
  ENST ID: ENST00000428567
  CDS Start-End: 123-735
tttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaa

SEQ ID NO: 130204 - DNA, 627 bp, Homo sapiens
  Payload ID: 5479
  Gene Symbol: ECT2
  Gene Name: epithelial cell transforming 2
  ENST ID: ENST00000444250
  CDS Start-End: 1-627
tttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaac

SEQ ID NO: 130205 - DNA, 637 bp, Homo sapiens
  Payload ID: 5479
  Gene Symbol: ECT2
  Gene Name: epithelial cell transforming 2
  ENST ID: ENST00000415665
  CDS Start-End: 160-637
aggcttcccggatccgggaactccctcgccgcaccccacccccagcagccgggccctgacgcggagtgggagaccgaagcccccagtattgctgggcatcttcgccctcacctgttggctcttttggacagaagagtctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaag

SEQ ID NO: 130206 - DNA, 2825 bp, Homo sapiens
  Payload ID: 5479
  Gene Symbol: ECT2
  Gene Name: epithelial cell transforming 2
  Uniprot ID: Q9H8V3
  ENST ID: ENST00000441497
  CDS Start-End: 75-2726
ttttgcccaatgaccatgtttatgtatttttattcaaattttattttttcagctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagc

SEQ ID NO: 130207 - DNA, 560 bp, Homo sapiens
  Payload ID: 5479
  Gene Symbol: ECT2
  Gene Name: epithelial cell transforming 2
  ENST ID: ENST00000426894
  CDS Start-End: 241-560
gaatcggttgtggcggccgccggcgaggaatggcggtatttgtgagaggagtcggcgtttgaagaggtggaactcctagggcttttttgagagtgacggagtctacctcttgttacctagactggagtgcagtggcacgatctcggctcactgcaacctctgcctcccgggttcaagcgattctcctgcctcagcctcctgagtagctgggattacagctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctt

SEQ ID NO: 130208 - DNA, 4363 bp, Homo sapiens
  Payload ID: 5479
  Gene Symbol: ECT2
  Gene Name: epithelial cell transforming 2
  Uniprot ID: Q9H8V3
  ENST ID: ENST00000417960
  CDS Start-End: 478-3126
aatcggcatggctcttagagagagcagcttagtttttgaatcggttgtggcggccgccggcgaggaatggcggtatttgtgagaggagtcggcgtttgaagaggtggaactcctagggcttttttgagagtgacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatcatggctgaaaatagtgtattaacatccactactgggaggactagcttggcagactcttccatttttgattctaaagttactgagatttccaaggaaaacttacttattggatctacttcatatgtagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 130209 - DNA, 4406 bp, Homo sapiens
  Payload ID: 5479
  Gene Symbol: ECT2
  Gene Name: epithelial cell transforming 2
  Uniprot ID: Q9H8V3
  ENST ID: ENST00000540509
  CDS Start-End: 519-3170
ggagactcctgcctatgggaaagaggttgacatcacgcgccaatcggcatggctcttagagagagcagcttagtttttgaatcggttgtggcggccgccggcgaggaatggcggtatttgtgagaggagtcggcgtttgaagaggtggaactcctagggcttttttgagagtgacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 130210 - DNA, 4343 bp, Homo sapiens
  Payload ID: 5480
  Gene Symbol: ECT2L
  Gene Name: epithelial cell transforming 2 like
  Uniprot ID: Q008S8
  ENST ID: ENST00000367682
  CDS Start-End: 186-2900
agttggcgcactcgattttcactgcgcggttccaagaggagacagccgccactgtaccgggcctcatagccacttcctagaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttctctacagtgttaccacgcttcatttctctatatatcttttcctttttgagtccgaaagatttgtgtgccgctgcccaagtcagctggccctggaagtttttaactgaacaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggaactactggagagacaaagagaaaagtgcctgaggaaaagaatttgggagaaaattgcactacgtaagaaggagttattcaaagttcgacccccttgggtgagtggaacttgctgctctagcgtgctaaagcccagatgccaaccacgcctctcccagactgtaagggagcgagtgggattacatgaagctttggagaaacagcttgttttgacatcgttagaaaccttgcccaagcgaagcaatatttctggaagccattcctaccctttattatcaaagaaaaattggcatggagttcataaaaatgatgacagatcttcatatgctctccggccacacttcatgttaatatcatcccggattcctgcgtatgagatggtgatggagagtgtgaaggctggtgttgtttctgtggtatatgaacacagcgtaaccttggaaagccttctgtatcttatagaaaaagctctggatgggcagaaggcacagagcatcggaatatttagcgatggagacagcagagaaatcaatttactccaaggctataaaattggtgttaaaaatttactgaggcctgaagtgagagatttctgggagaaattaggaagctatgtggccactgaagaagaagggggtcacgtggacttcttcgtgccccttggagcatcagaggcaggaattgaagttctttcccagctgtctcaactaactggcacgttctttacggcccccactgggattgcaactggctcttaccagcacattcttagtgattggctgggatcccaatggggaaaggccccctcttccatctacttctgcgaatcgaagctacagacgtggtccagcttcacagacttcctagaagaaaccttgaaaacagtaaggaagcagctgtatcctttcttcaaggaactgcagaagagcatcagtggcaggatgatagggcagtttatgtttgacaccatgggtatgaccaacattctaaacaaccaagatactgcgcaagctctggcagatggattgatggagttgtcaaaagaagattctgaaagaaatgttgtagaagacaattcttgggacacaaagtccaggctcagcaaaaatgatttaaattttgaagcactgattaatctggagagaatactccagaaggactcagcagaaaagcgagctagagttgtcagagaactcttacagagtgagagaaaatacgtgcagatactggaaattgtgagagatgtttatgtcgcaccactgaaagcagcattgtcatcaaacagagcgattctgagtgctgccaatatccagatcattttctgtgacattctacagattttaagtctcaacaggcagtttctagataacctgagagacagactgcaggaatggggcccagctcactgtgtgggagaaatagtcacgaagtttggaagccagttaaacacatataccaatttcttcaacaattaccctgtcattctgaaaactattgagaagtgcagagaaatgataccagcattccgaactttcctgaagaggcatgataagaccattgttaccaaaatgctgagcctgccagagctgctgctgtacccatcccgaagatttgaagaataccttaatcttctctacgctgtcaggcttcatacccctgcagagcatgttgaccgtggggacttgaccactgcaattgaccaaatcaaaaaatataaaggttatatagatcagatgaagcaaaacatcactatgaaggatcatctgtcagatatacagagaatcatctggggatgccctactctatcagaagtaaacagatatctgattagggtacaagatgtagcccaacttcattgctgtgatgaagaaataagtttctctttaaggctctatgaacacatccatgatctcagccttttcctcttcaatgatgccctgctcgtttctagtcggggcacatctcacactccatttgagaggacttcaaaaacaacctaccagttcattgcatcagtggcccttcatcggttactcatagaaaatattccagattccaagtatgtcaagaatgcatttattcttcagggtccaaaatataaatggatttgtgctacagaaatagaggatgataagttcctatggctgtcagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatctttccaacttttaaactttatcacttgtgctcacttatgtagaatgtataagtacattttgagtccaaaattttgaactacttcttttggtagctgtatttcatggataatattatttagagtaatttgatgtgatgaaacctaagacagagcaagcacattgtgtaaagctttgttttatgatctaatgaaaaaagcagaatgaaagtgtttcttaagtgatcagtctagaaagatattttaatttgttggtgatttaccatttttaacattttcatgaaacaattattgatttaaaatatggataagagggctgggcatgatgactcacgcctgtaatcccagcactttgggaggctgaggtggcagattacctgaggtcaggagtttgagaccagcctcaccaacatggagaaaccccgtctctactaaaaatacaaaattagccaggcatggtggcacacgcctgtagtccctgctacttgcgacgctgaggcaggagaagaatcacttgtacccgggagtcggaggttgtagtaagctgagatggctccattgcacttcagcctgggtgacaagagcgaacctctgtctcaaaaaaaaaagaaaaaaaaaaggacaagaaatacaaatggcaatttactcaaaaacttgtcacacttatccttagtatgaatgtactcctctagagagcattaaagatataccactacaaagtactaaaaagttttctataatttttaagtgttatttattggaaggctaaattctaagaagctttaacaaatatttttgacattgttaaattagaaggctatttttaaaaagcatattttaaaaaacaaaactaaatggaaacagcaaaacttgcttgtaatgaaatacagctgagtaaaaatgtttctttgaaaacaaagacactcagaaaaacaggtgttgagtagtttcctgggcctttaatgctttaaatttattatttaacaactaaagccatactgaaagccacttggaaacttcagctgatgtatatttttacctagatattgtcaggtaaaaattgtattaatcttggaagcttgaggttgtcagtttcccttgttcttcaaattcttgtttacagtaacaaagtctatcggtgcagtttaggactgtgaatctatagtatttaaacattttttctttcagaaatgaaaatacaaaatcttctatttcttaaaactttaaatcttgttaaaaagatgaacaaaagttaaaatattatgctgttttattggtgtaaaaccacacttctgattctgccaagat

SEQ ID NO: 130211 - DNA, 548 bp, Homo sapiens
  Payload ID: 5480
  Gene Symbol: ECT2L
  Gene Name: epithelial cell transforming 2 like
  ENST ID: ENST00000401414
  CDS Start-End: 317-548
actcgattttcactgcgcggttccaagaggagacagccgccactgtaccgggcctcatagccacttcctagaggtaaagaaaaagtcaacctccttggctgatgaatcacggcagtttctaagtagcatttcctggaacgttcttaatgcttcccattttcccagcaaagtaaaaaacaacttttgtttaaattcagatttgggtgaaagcaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttct

SEQ ID NO: 130212 - DNA, 4319 bp, Homo sapiens
  Payload ID: 5480
  Gene Symbol: ECT2L
  Gene Name: epithelial cell transforming 2 like
  Uniprot ID: Q008S8
  ENST ID: ENST00000423192
  CDS Start-End: 162-2876
aagggcggtggctcgcacggcgcgggcggctttgctcactgcagctggggagatgcaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttctctacagtgttaccacgcttcatttctctatatatcttttcctttttgagtccgaaagatttgtgtgccgctgcccaagtcagctggccctggaagtttttaactgaacaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggaactactggagagacaaagagaaaagtgcctgaggaaaagaatttgggagaaaattgcactacgtaagaaggagttattcaaagttcgacccccttgggtgagtggaacttgctgctctagcgtgctaaagcccagatgccaaccacgcctctcccagactgtaagggagcgagtgggattacatgaagctttggagaaacagcttgttttgacatcgttagaaaccttgcccaagcgaagcaatatttctggaagccattcctaccctttattatcaaagaaaaattggcatggagttcataaaaatgatgacagatcttcatatgctctccggccacacttcatgttaatatcatcccggattcctgcgtatgagatggtgatggagagtgtgaaggctggtgttgtttctgtggtatatgaacacagcgtaaccttggaaagccttctgtatcttatagaaaaagctctggatgggcagaaggcacagagcatcggaatatttagcgatggagacagcagagaaatcaatttactccaaggctataaaattggtgttaaaaatttactgaggcctgaagtgagagatttctgggagaaattaggaagctatgtggccactgaagaagaagggggtcacgtggacttcttcgtgccccttggagcatcagaggcaggaattgaagttctttcccagctgtctcaactaactggcacgttctttacggcccccactgggattgcaactggctcttaccagcacattcttagtgattggctgggatcccaatggggaaaggccccctcttccatctacttctgcgaatcgaagctacagacgtggtccagcttcacagacttcctagaagaaaccttgaaaacagtaaggaagcagctgtatcctttcttcaaggaactgcagaagagcatcagtggcaggatgatagggcagtttatgtttgacaccatgggtatgaccaacattctaaacaaccaagatactgcgcaagctctggcagatggattgatggagttgtcaaaagaagattctgaaagaaatgttgtagaagacaattcttgggacacaaagtccaggctcagcaaaaatgatttaaattttgaagcactgattaatctggagagaatactccagaaggactcagcagaaaagcgagctagagttgtcagagaactcttacagagtgagagaaaatacgtgcagatactggaaattgtgagagatgtttatgtcgcaccactgaaagcagcattgtcatcaaacagagcgattctgagtgctgccaatatccagatcattttctgtgacattctacagattttaagtctcaacaggcagtttctagataacctgagagacagactgcaggaatggggcccagctcactgtgtgggagaaatagtcacgaagtttggaagccagttaaacacatataccaatttcttcaacaattaccctgtcattctgaaaactattgagaagtgcagagaaatgataccagcattccgaactttcctgaagaggcatgataagaccattgttaccaaaatgctgagcctgccagagctgctgctgtacccatcccgaagatttgaagaataccttaatcttctctacgctgtcaggcttcatacccctgcagagcatgttgaccgtggggacttgaccactgcaattgaccaaatcaaaaaatataaaggttatatagatcagatgaagcaaaacatcactatgaaggatcatctgtcagatatacagagaatcatctggggatgccctactctatcagaagtaaacagatatctgattagggtacaagatgtagcccaacttcattgctgtgatgaagaaataagtttctctttaaggctctatgaacacatccatgatctcagccttttcctcttcaatgatgccctgctcgtttctagtcggggcacatctcacactccatttgagaggacttcaaaaacaacctaccagttcattgcatcagtggcccttcatcggttactcatagaaaatattccagattccaagtatgtcaagaatgcatttattcttcagggtccaaaatataaatggatttgtgctacagaaatagaggatgataagttcctatggctgtcagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatctttccaacttttaaactttatcacttgtgctcacttatgtagaatgtataagtacattttgagtccaaaattttgaactacttcttttggtagctgtatttcatggataatattatttagagtaatttgatgtgatgaaacctaagacagagcaagcacattgtgtaaagctttgttttatgatctaatgaaaaaagcagaatgaaagtgtttcttaagtgatcagtctagaaagatattttaatttgttggtgatttaccatttttaacattttcatgaaacaattattgatttaaaatatggataagagggctgggcatgatgactcacgcctgtaatcccagcactttgggaggctgaggtggcagattacctgaggtcaggagtttgagaccagcctcaccaacatggagaaaccccgtctctactaaaaatacaaaattagccaggcatggtggcacacgcctgtagtccctgctacttgcgacgctgaggcaggagaagaatcacttgtacccgggagtcggaggttgtagtaagctgagatggctccattgcacttcagcctgggtgacaagagcgaacctctgtctcaaaaaaaaaagaaaaaaaaaaggacaagaaatacaaatggcaatttactcaaaaacttgtcacacttatccttagtatgaatgtactcctctagagagcattaaagatataccactacaaagtactaaaaagttttctataatttttaagtgttatttattggaaggctaaattctaagaagctttaacaaatatttttgacattgttaaattagaaggctatttttaaaaagcatattttaaaaaacaaaactaaatggaaacagcaaaacttgcttgtaatgaaatacagctgagtaaaaatgtttctttgaaaacaaagacactcagaaaaacaggtgttgagtagtttcctgggcctttaatgctttaaatttattatttaacaactaaagccatactgaaagccacttggaaacttcagctgatgtatatttttacctagatattgtcaggtaaaaattgtattaatcttggaagcttgaggttgtcagtttcccttgttcttcaaattcttgtttacagtaacaaagtctatcggtgcagtttaggactgtgaatctatagtatttaaacattttttctttcagaaatgaaaatacaaaatcttctatttcttaaaactttaaatcttgttaaaaagatgaacaaaagttaaaatattatgctgttttattggtgtaaaaccacacttctgattctgccaagat

SEQ ID NO: 130213 - DNA, 4483 bp, Homo sapiens
  Payload ID: 5480
  Gene Symbol: ECT2L
  Gene Name: epithelial cell transforming 2 like
  Uniprot ID: Q008S8
  ENST ID: ENST00000541398
  CDS Start-End: 326-3040
agttggcgcactcgattttcactgcgcggttccaagaggagacagccgccactgtaccgggcctcatagccacttcctagaggtaaagaaaaagtcaacctccttggctgatgaatcacggcagtttctaagtagcatttcctggaacgttcttaatgcttcccattttcccagcaaagtaaaaaacaacttttgtttaaattcagatttgggtgaaagcaggtgatcttaattgcacacctattgaaataaacctgtagtttctagaagtggaagaaaatttgctgagacgtcagctggggattcttcctggagaactccagaaatggagagcttccacaccagatttagtgcctggacaccttttagcaacaagtcattaaatagacagctctttcaggaaagagtggctcttataagtcattggtttgacctctggactaacaagcaacgtcaagaattcttattcgcaatttttttaagatgcactaaatcacaattaaggtttgtccaagactggttttcagaaaggatgcaagtggccaaagtggacttctctacagtgttaccacgcttcatttctctatatatcttttcctttttgagtccgaaagatttgtgtgccgctgcccaagtcagctggccctggaagtttttaactgaacaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggaactactggagagacaaagagaaaagtgcctgaggaaaagaatttgggagaaaattgcactacgtaagaaggagttattcaaagttcgacccccttgggtgagtggaacttgctgctctagcgtgctaaagcccagatgccaaccacgcctctcccagactgtaagggagcgagtgggattacatgaagctttggagaaacagcttgttttgacatcgttagaaaccttgcccaagcgaagcaatatttctggaagccattcctaccctttattatcaaagaaaaattggcatggagttcataaaaatgatgacagatcttcatatgctctccggccacacttcatgttaatatcatcccggattcctgcgtatgagatggtgatggagagtgtgaaggctggtgttgtttctgtggtatatgaacacagcgtaaccttggaaagccttctgtatcttatagaaaaagctctggatgggcagaaggcacagagcatcggaatatttagcgatggagacagcagagaaatcaatttactccaaggctataaaattggtgttaaaaatttactgaggcctgaagtgagagatttctgggagaaattaggaagctatgtggccactgaagaagaagggggtcacgtggacttcttcgtgccccttggagcatcagaggcaggaattgaagttctttcccagctgtctcaactaactggcacgttctttacggcccccactgggattgcaactggctcttaccagcacattcttagtgattggctgggatcccaatggggaaaggccccctcttccatctacttctgcgaatcgaagctacagacgtggtccagcttcacagacttcctagaagaaaccttgaaaacagtaaggaagcagctgtatcctttcttcaaggaactgcagaagagcatcagtggcaggatgatagggcagtttatgtttgacaccatgggtatgaccaacattctaaacaaccaagatactgcgcaagctctggcagatggattgatggagttgtcaaaagaagattctgaaagaaatgttgtagaagacaattcttgggacacaaagtccaggctcagcaaaaatgatttaaattttgaagcactgattaatctggagagaatactccagaaggactcagcagaaaagcgagctagagttgtcagagaactcttacagagtgagagaaaatacgtgcagatactggaaattgtgagagatgtttatgtcgcaccactgaaagcagcattgtcatcaaacagagcgattctgagtgctgccaatatccagatcattttctgtgacattctacagattttaagtctcaacaggcagtttctagataacctgagagacagactgcaggaatggggcccagctcactgtgtgggagaaatagtcacgaagtttggaagccagttaaacacatataccaatttcttcaacaattaccctgtcattctgaaaactattgagaagtgcagagaaatgataccagcattccgaactttcctgaagaggcatgataagaccattgttaccaaaatgctgagcctgccagagctgctgctgtacccatcccgaagatttgaagaataccttaatcttctctacgctgtcaggcttcatacccctgcagagcatgttgaccgtggggacttgaccactgcaattgaccaaatcaaaaaatataaaggttatatagatcagatgaagcaaaacatcactatgaaggatcatctgtcagatatacagagaatcatctggggatgccctactctatcagaagtaaacagatatctgattagggtacaagatgtagcccaacttcattgctgtgatgaagaaataagtttctctttaaggctctatgaacacatccatgatctcagccttttcctcttcaatgatgccctgctcgtttctagtcggggcacatctcacactccatttgagaggacttcaaaaacaacctaccagttcattgcatcagtggcccttcatcggttactcatagaaaatattccagattccaagtatgtcaagaatgcatttattcttcagggtccaaaatataaatggatttgtgctacagaaatagaggatgataagttcctatggctgtcagtacttcgaaatgcaatcaaaagcagtatggagaagtgagaccgaacttgaaaacttcaggggtgccaattctccccagcaaagacagacaacatgtattttctgttccaaaatatccagtaagaaacagaataactgtcatggatgatgagataaactaagatgacccataggatctttccaacttttaaactttatcacttgtgctcacttatgtagaatgtataagtacattttgagtccaaaattttgaactacttcttttggtagctgtatttcatggataatattatttagagtaatttgatgtgatgaaacctaagacagagcaagcacattgtgtaaagctttgttttatgatctaatgaaaaaagcagaatgaaagtgtttcttaagtgatcagtctagaaagatattttaatttgttggtgatttaccatttttaacattttcatgaaacaattattgatttaaaatatggataagagggctgggcatgatgactcacgcctgtaatcccagcactttgggaggctgaggtggcagattacctgaggtcaggagtttgagaccagcctcaccaacatggagaaaccccgtctctactaaaaatacaaaattagccaggcatggtggcacacgcctgtagtccctgctacttgcgacgctgaggcaggagaagaatcacttgtacccgggagtcggaggttgtagtaagctgagatggctccattgcacttcagcctgggtgacaagagcgaacctctgtctcaaaaaaaaaagaaaaaaaaaaggacaagaaatacaaatggcaatttactcaaaaacttgtcacacttatccttagtatgaatgtactcctctagagagcattaaagatataccactacaaagtactaaaaagttttctataatttttaagtgttatttattggaaggctaaattctaagaagctttaacaaatatttttgacattgttaaattagaaggctatttttaaaaagcatattttaaaaaacaaaactaaatggaaacagcaaaacttgcttgtaatgaaatacagctgagtaaaaatgtttctttgaaaacaaagacactcagaaaaacaggtgttgagtagtttcctgggcctttaatgctttaaatttattatttaacaactaaagccatactgaaagccacttggaaacttcagctgatgtatatttttacctagatattgtcaggtaaaaattgtattaatcttggaagcttgaggttgtcagtttcccttgttcttcaaattcttgtttacagtaacaaagtctatcggtgcagtttaggactgtgaatctatagtatttaaacattttttctttcagaaatgaaaatacaaaatcttctatttcttaaaactttaaatcttgttaaaaagatgaacaaaagttaaaatattatgctgttttattggtgtaaaaccacacttctgattctgccaagat

SEQ ID NO: 130214 - DNA, 5921 bp, Homo sapiens
  Payload ID: 5481
  Gene Symbol: EMP1
  Gene Name: epithelial membrane protein 1
  Uniprot ID: P54849
  ENST ID: ENST00000256951
  CDS Start-End: 200-673
accgcccattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttcattgtgtgaatgtttttttctaaaaaaaatgtggagaaatatggataattatgacatttatccctcattaagctgcctatcagtttgatttggacaacttgacatttatttgagacattaagctactttctggtaatatattaggcatttctgcaatagctctttcaggtaactgaatattattaagcatagttttatcttgctttgattaaacctcttaggcaaaaaatggaacttcataagctaatacattagaaaggggttatgattataaatcagaaatgcttgtgacattaagaaatgaggcacttgtgaaatttctttgaaatagccagctcctctaatgtgtcttcaaaatataaagtgattcacaaaggcatgcatcacacctatttgtagcagcccattcattacataaaccagggcatacctgtgtgggctctgtgagtgaagggaggcttcactactttctgtgagcagtaaggactggtatctttctgtgagcaataaggactggataaagactgcatatccttgtgtcgtgtcagcaccaatacaataaggagggttttaatgtgaagcaggcaatcttccagccccttctggtcttggatgaaatagttgcacagagtattgcaccaaaaatacacaatggaggctgaaaagttcaacatattttaagtcaattaatcaaattgcattgattcttgatgctttcttagaggcctacatgatttcttagattgctctgataaactatcataaggggtccacctcccctcatttagctcccccagggatttcttttcccccatgtcatacacccagtcctaaatcaacccccaaggctatccttccatcccttctgcagagggaacttttgtcagactctgcaacaaactcctagctctatccagagtgtcctctgctgctaagattggtatctttctcctcaaaagcctggatggtgaatgggggtgcattagtcagaattctccagagaaacagaaaaaataagattcgcgtgtgtgtgcaaacatatatataaataaataaaaatatatttattttaaggaattgactcacatgattttgaaggcaggcaagcccaaagtctgcaaggggtgggccagcagagagctggtgctacagtgcgggtctgaaagttgccagagtcccttttatagagaagcttaaaaaatatttgttgaattaaatgtcttaggtagagacaaattgaattaaagtggttaagtaaatactcttaggtgaaatttgtgcaaattatgagtataaagagggtgagctacagaactctccatgaccactcaagaatgggacccaaaggcaaatgataacttattcattcatcaagggataaacttgagttatcaaatggttaatagataaagatcccactctgccttggatttagccatcgcagtccctgtgtaaaaccccaccggctttcaggcatggaaaaaaatttcacaaaggccttgaaagaaggcatatgaagaccaaaaggatattgagcagggttccatacttgaataaaggaagaaactcccttcaatgtttactaagaaatagttagaatatagcatatcctgtatagatgaaatgtcctagcgaaaatgtttaaatgtatttaaagaagagctagattttgtggggggagagaagggaataggataggctggtgggaggaagaatgaaaagaagaaaacttgttggaaattttggagtagattgtgaggaggggtgactcactttaaagatgtatcatttggaggtagacacgattttcagagcacaaaacagataaggaaagatgtatgctgattgtgtggagcccaagggaaggcggggttttggagtcttacgtggctttgtttctgaaagggagacatgtgaagcctactcctgaggcgggaggctggggacatgaccatcaagacctataattgataaacaactaggggctgggtgctgcacctacatgctggggaaatagaaaatgaagcagacatgtgtcccatcttcttccagctttcagtctagcttggaaataaatctcatacctagagaaaatggaggatctgtgggatgtagatgaggtgggagcatgaatgcctagggagggaagaagaaagattttcagttcttcagcttttcctcatgaccctatctcatgccatgagcaattgtctggcatctcctgtgggttggaccactgctgcatttcttacttgccaacatcactttgtcccaaatgccattcctttgttccagggcctccttgtcttccatctggggaactggaggtgagaagcattataatagcctctctgcctttatctacaatctctccaacctgtgctttatgctgatgtcaggatgggcgttgatggatgcttctatcactgtcggggcagggagggccagaacactagcataagatgtcaatatgtctatccatatgtcaggtccatactcaactcaagcttctggttaactgctgatctattggcaactccagttcccaataagttcctcatctccttctgagaccacctcagtgtggacttaatcgtccacatcactgtcagcattttggttaaaaccattcaacaagtctccaggaagctccaaactttccttcatcttcctgtcttcttctgagccctccaaactcttccaacctctacccgttacccagttccaaaggtgcttccacactttcaagtatctttatagcaatgccccactcctggtaccaaattcctgtattagtctgttttcacactgctatgaagacatacttgagactcggtaatttatatagaaaagaggtttaattgacaaaaaagctaacaaagtgagccctgattcaaaaatgactgtctacacttggcacatgagggactttatgatattaagagattaattaaacaacagtggatggggaggaagaacagacttttgagctcttcccaatataggaatgtgttagttctaaaaattttcttaagttgtttgcttggaactcagagtatatttttccatacgaaaaattcagaactattttatttatgatatgggctaaaaagacttctgtaatctagcttggaaacttaataatcattaaacttattttcaatga

SEQ ID NO: 130215 - DNA, 675 bp, Homo sapiens
  Payload ID: 5481
  Gene Symbol: EMP1
  Gene Name: epithelial membrane protein 1
  Uniprot ID: P54849
  ENST ID: ENST00000396301
  CDS Start-End: 130-555
agtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgcttcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggag

SEQ ID NO: 130216 - DNA, 1039 bp, Homo sapiens
  Payload ID: 5481
  Gene Symbol: EMP1
  Gene Name: epithelial membrane protein 1
  ENST ID: ENST00000431267
  CDS Start-End: 177-449
attacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgta

SEQ ID NO: 130217 - DNA, 571 bp, Homo sapiens
  Payload ID: 5481
  Gene Symbol: EMP1
  Gene Name: epithelial membrane protein 1
  ENST ID: ENST00000538364
  CDS Start-End: 133-571
ctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctct

SEQ ID NO: 130218 - DNA, 505 bp, Homo sapiens
  Payload ID: 5481
  Gene Symbol: EMP1
  Gene Name: epithelial membrane protein 1
  ENST ID: ENST00000537612
  CDS Start-End: 1-210
atgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttc

SEQ ID NO: 130219 - DNA, 1436 bp, Homo sapiens
  Payload ID: 5481
  Gene Symbol: EMP1
  Gene Name: epithelial membrane protein 1
  ENST ID: ENST00000544053
  CDS Start-End: 271-555
acacaccccagtacaccagcagaggaaacttataacctcgggaggcaggtccttcccctcagtgcggtcacatacttccagaagagcggaccagggctgctgccagcacctgccactcagagcgcctctgtcgctgggacccttcaggtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctctggttatttgttctcttgtggagaaccttggattgctgcttaggttaagaaccctcatctgcttcattgttcaaaaccagtgctcctgggtagctaccaagtggcagtgcatatctgttagtagcacgtgtgtacaagacacttcaagaaggcagaaaggtaggagttctcagaaagatgaaaccactgccacaatgcacatcattattgtgattctcacttaattgttgttctttcccaatatactcggtttggtggaaggacatgctcttttgcatccctgagtagctttcctagacccacaagggccagacaggacagctgggtggtaggcatgaggttctgtgttttacatcacagcgtggccacacaaaccagtgcagacatgagagcccagacacctctaatttatcaacataccgtcgagcttggcccaggggacatccatcagaactcctgtttagggacaaacaagcagaattcattttcctattgctaatgagggaaataggatcttcttaaaattagtaaaactttttctcgactttaatgtaagaaaacacaccgacaaatctccttttcccctgcagggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccct

SEQ ID NO: 130220 - DNA, 555 bp, Homo sapiens
  Payload ID: 5481
  Gene Symbol: EMP1
  Gene Name: epithelial membrane protein 1
  ENST ID: ENST00000542474
  CDS Start-End: 546-555
acacaccccagtacaccagcagaggaaacttataacctcgggaggcaggtccttcccctcagtgcggtcacatacttccagaagagcggaccagggctgctgccagcacctgccactcagagcgcctctgtcgctgggacccttcaggactgctgggcagaccgctggggaaaggaaagagatcccttctgtggagagtggaaaggactcactgtgccttcctcagcccttcctgcttcctccagagaccagattaggcccatcaagttcccagccttgtcagtgggcttcatggagacccctcacccgggaatgtagaccctcttggcttgctctgggtggctctagggatttcaggtagtgccagacccacagggactactggagagagacacgttgaagaccggggaaaacttgtggatgaggcaagactgcttttctgtagactctatggagcctggtggggcacataactgaaacgtggacacaggaaagggcaggagaactctctttgctcacaagttaccaaaaaaaaaagagccaacatgttggtat

SEQ ID NO: 130221 - DNA, 5197 bp, Homo sapiens
  Payload ID: 5482
  Gene Symbol: EMP2
  Gene Name: epithelial membrane protein 2
  Uniprot ID: P54851
  ENST ID: ENST00000359543
  CDS Start-End: 211-714
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaaaaaaaaaaaaagaaaaaagaaaaaaaaaatccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttcttttttttttttttttttgagactgagttttgctcttgttgcccaggctggagtgcagtggcaccatcttggctcaccgcaacctctgcctcctgggttcaagtgattctcctgcctcagcctcccgagtagctgggattacaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactgctgtacaacattcagtgcccacatccacctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtgaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctagggcagaatgctgccattttgaggggcagggggtcagctgatttctcatcaagataataatgtatggtttttacactaagcaactgataaatggacaatttatcactgga

SEQ ID NO: 130222 - DNA, 781 bp, Homo sapiens
  Payload ID: 5482
  Gene Symbol: EMP2
  Gene Name: epithelial membrane protein 2
  Uniprot ID: P54851
  ENST ID: ENST00000536829
  CDS Start-End: 222-725
ggcctgggagtccttgcagggtggcctgggtgactgctcaccagcccggccctccccagggttctgggccagagcctccctggccgttggagcgggagctgtgggtggaacacttctgaattgggagattgcctcggacctccagacgccgaacatctcagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccat

SEQ ID NO: 130223 - DNA, 876 bp, Homo sapiens
  Payload ID: 5483
  Gene Symbol: EMP3
  Gene Name: epithelial membrane protein 3
  Uniprot ID: P54852
  ENST ID: ENST00000270221
  CDS Start-End: 302-793
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgg

SEQ ID NO: 130224 - DNA, 683 bp, Homo sapiens
  Payload ID: 5483
  Gene Symbol: EMP3
  Gene Name: epithelial membrane protein 3
  Uniprot ID: P54852
  ENST ID: ENST00000597279
  CDS Start-End: 109-600
ctccagctctgacttttttcgcggctctcgcgcgaatcctatccatttcctccagaagatgtccaacagtcaccagtctggcagcagggtggggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgg

SEQ ID NO: 130225 - DNA, 502 bp, Homo sapiens
  Payload ID: 5483
  Gene Symbol: EMP3
  Gene Name: epithelial membrane protein 3
  ENST ID: ENST00000593437
  CDS Start-End: 19-502
tcggcttccactgcagccatgtcactcctcttgctggtggtctcagcccttcacatcctcattcttatactgcttttcgtggccactttggacaagtcctggtggactctccctgggaaagagtccctgaatctctggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcg

SEQ ID NO: 130226 - DNA, 761 bp, Homo sapiens
  Payload ID: 5483
  Gene Symbol: EMP3
  Gene Name: epithelial membrane protein 3
  ENST ID: ENST00000596315
  CDS Start-End: 394-678
attgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcgtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgg

SEQ ID NO: 130227 - DNA, 753 bp, Homo sapiens
  Payload ID: 5483
  Gene Symbol: EMP3
  Gene Name: epithelial membrane protein 3
  ENST ID: ENST00000599704
  CDS Start-End: 485-753
ggggcttccccgtaaggggcgggcttcgagggtcgcgtttggaaggccttacgaggggcccggtggaagggcggtgaagggcgggctaatcgggaggcgctcaggccttgaaggcctgcgggaggtcgaaatggtcctggggaggtcgaggctgaggtctcactagtaccgcgggcctggaagcggcgggagttgaaagagcctgcggtgacctgtatggaagccctcgaagccaggccgaggtcctacaagacggagcccgagaggtgccggtcttaagctgactgtgaccacgttaaattaaggattcataggaaggaaggcggtgtcgaagccgggagttgcgcggagaaggagcgctcaacacagcctcagcggttcactacgcaagcgcgaccaacggcttcccgggaagcagccaaaaacgcttggccgcctaccacgtccgcgcgctggagggcggaagtgggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacac

SEQ ID NO: 130228 - DNA, 667 bp, Homo sapiens
  Payload ID: 5483
  Gene Symbol: EMP3
  Gene Name: epithelial membrane protein 3
  ENST ID: ENST00000599255
  CDS Start-End: 66-257
agcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggtgaggggtgagggcggcgggactggtcttcaaaggggaaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataa

SEQ ID NO: 130229 - DNA, 263 bp, Homo sapiens
  Payload ID: 5483
  Gene Symbol: EMP3
  Gene Name: epithelial membrane protein 3
  ENST ID: ENST00000594198
  CDS Start-End: 94-263
cggggcacggaggcccgagcgagggacaagactccgactccagctctgacttttttcgcggctctcggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcct

SEQ ID NO: 130230 - DNA, 847 bp, Homo sapiens
  Payload ID: 5484
  Gene Symbol: EPGN
  Gene Name: epithelial mitogen
  Uniprot ID: Q6UW88
  ENST ID: ENST00000332112
  CDS Start-End: 48-449
cgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtatgaaaaagacaaaatatgaagtcacttcatatgcaatcgtttgacaaatagttattcaggccctataatgtgtcaggcactgacatgtaaaatttttttaattaaaaaagagctgtaatctggcaaaaagtttctatgtaatatttttcatgccttttctcataaacccagacgagtggtaaaaatttgccttcagttgtaataggagagttcaaacgtacagtctcccttcaacctatctctgtctgcccatatcaaaattataaatgaggaggacagcaggccccaagaaagtagggactaagtatgtcttgttcaaaattgtatattcagtgacttacactatgcctagcacacaacacacactgagtaaatatttgttgagtgaaataaaatcaagaaacaagtaaaaactga

SEQ ID NO: 130231 - DNA, 738 bp, Homo sapiens
  Payload ID: 5484
  Gene Symbol: EPGN
  Gene Name: epithelial mitogen
  ENST ID: ENST00000446430
  CDS Start-End: 1-391
gacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactagactcgaaaataatgaaagttgggatcacaatgaaatgagaagataaaattcagcgttggcctttagactttgccatccttaaggagtgatggaagccaagtgaacaagcctcagtgacacaagtcaaattcatagtttcactctgggttttttgttgttgtgtggttattattctcactacagaaagactgagtttcatgctcctggctatgtcagatgtgaattttcatgggaataataatcaacctt

SEQ ID NO: 130232 - DNA, 1196 bp, Homo sapiens
  Payload ID: 5484
  Gene Symbol: EPGN
  Gene Name: epithelial mitogen
  Uniprot ID: Q6UW88
  ENST ID: ENST00000413830
  CDS Start-End: 62-526
aaaaaccttccacccgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactagactcgaaaataatgaaagttgggatcacaatgaaatgagaagataaaattcagcgttggcctttagactttgccatccttaaggagtgatggaagccaagtgaacaagcctcagtgacacaagtcaaattcatagtttcactctgggttttttgttgttgtgtggttattattctcactacagaaagactgagtttcatgctcctggctatgtcagatgtgaattttcatgggaataataatcaaccttgcagcaagccaaagcaatgcctcgcttgggttcttcatgttcttactacccagcgttttttaccacctagatgggcctctctaagtctatttgctcaatgaaccttatcccaaacttgttgttttcatggtgtctgaaagaatgtgatgtcagcttttagaatgaaatcagtgttaaggtacctccagtgaaccaaacatgtgtcttaaatctaagccactgaaaacagaagggaatgtccaaggcaaatacaaatcatacacagcttgtaacaacatacagcctttctatgtgaaataatggaataaactaaagagtttctg

SEQ ID NO: 130233 - DNA, 630 bp, Homo sapiens
  Payload ID: 5484
  Gene Symbol: EPGN
  Gene Name: epithelial mitogen
  ENST ID: ENST00000502835
  CDS Start-End: 61-345
aaaaccttccacccgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgaaacctgtaataaagtaaggaaagcagatggagcacaagaagaagctaagcaaagatgtggctttaactgaagtgtagccccagcctgattccacagggagatctagaatgtgaatagcagtgtagacctctcccaaggagatgaggcatctggatttcaatatcccatattattcaatcatggattcatgtggggtgtctaaaattgaaatcgccttacaatgtctgttctggagaaagacgaccactgtgaggcctttgtgaagaattttcatcaaggcatctg

SEQ ID NO: 130234 - DNA, 285 bp, Homo sapiens
  Payload ID: 5484
  Gene Symbol: EPGN
  Gene Name: epithelial mitogen
  Uniprot ID: Q6UW88
  ENST ID: ENST00000505212
  CDS Start-End: 1-285
atggctttgggagttccaatatcagtctatcttttattcaacgcaatgacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgtctaaaattgaaatcgccttacaatgtctgttctggagaaagacgaccactgtga

SEQ ID NO: 130235 - DNA, 339 bp, Homo sapiens
  Payload ID: 5484
  Gene Symbol: EPGN
  Gene Name: epithelial mitogen
  Uniprot ID: Q6UW88
  ENST ID: ENST00000503098
  CDS Start-End: 1-339
atggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtctaaaattgaaatcgccttacaatgtctgttctggagaaagacgaccactgtga

SEQ ID NO: 130236 - DNA, 312 bp, Homo sapiens
  Payload ID: 5484
  Gene Symbol: EPGN
  Gene Name: epithelial mitogen
  Uniprot ID: Q6UW88
  ENST ID: ENST00000514968
  CDS Start-End: 1-312
atggctttgggagttccaatatcagtctatcttttattcaacgcaatgacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtctaaaattgaaatcgccttacaatgtctgttctggagaaagacgaccactgtga

SEQ ID NO: 130237 - DNA, 222 bp, Homo sapiens
  Payload ID: 5484
  Gene Symbol: EPGN
  Gene Name: epithelial mitogen
  Uniprot ID: Q6UW88
  ENST ID: ENST00000509145
  CDS Start-End: 1-222
atggctttgggagttccaatatcagtctatcttttattcaacgctgacaacatagaaggacccatagccttgaagttctcacacctttgcctggaagatcataacagttactgcatcaacggtgcttgtgcattccaccatgagctagagaaagccatctgcaggtgtctaaaattgaaatcgccttacaatgtctgttctggagaaagacgaccactgtga

SEQ ID NO: 130238 - DNA, 312 bp, Homo sapiens
  Payload ID: 5484
  Gene Symbol: EPGN
  Gene Name: epithelial mitogen
  Uniprot ID: Q6UW88
  ENST ID: ENST00000502358
  CDS Start-End: 1-312
atggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgtctaaaattgaaatcgccttacaatgtctgttctggagaaagacgaccactgtga

SEQ ID NO: 130239 - DNA, 3756 bp, Homo sapiens
  Payload ID: 5485
  Gene Symbol: ESRP1
  Gene Name: epithelial splicing regulatory protein 1
  Uniprot ID: Q6NXG1
  ENST ID: ENST00000358397
  CDS Start-End: 146-2179
cttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 130240 - DNA, 3482 bp, Homo sapiens
  Payload ID: 5485
  Gene Symbol: ESRP1
  Gene Name: epithelial splicing regulatory protein 1
  Uniprot ID: Q6NXG1
  ENST ID: ENST00000454170
  CDS Start-End: 121-1947
ggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 130241 - DNA, 3770 bp, Homo sapiens
  Payload ID: 5485
  Gene Symbol: ESRP1
  Gene Name: epithelial splicing regulatory protein 1
  Uniprot ID: Q6NXG1
  ENST ID: ENST00000433389
  CDS Start-End: 191-2236
gcgtggagcaccgaccaggtgtgggcttgggtggttggttaccgccttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttg

SEQ ID NO: 130242 - DNA, 3746 bp, Homo sapiens
  Payload ID: 5485
  Gene Symbol: ESRP1
  Gene Name: epithelial splicing regulatory protein 1
  Uniprot ID: Q6NXG1
  ENST ID: ENST00000423620
  CDS Start-End: 246-2225
atacaaaaagggcaggcctcctgcgccctccttcccaccccccttcctgccctgggcgtggagcaccgaccaggtgtgggcttgggtggttggttaccgccttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 130243 - DNA, 609 bp, Homo sapiens
  Payload ID: 5485
  Gene Symbol: ESRP1
  Gene Name: epithelial splicing regulatory protein 1
  ENST ID: ENST00000522756
  CDS Start-End: 328-609
actattacctgaatgcttctattccttttttgatcttcgaaaagaattcaagaaatgttgccctggttcacctgatattgacaaactggacgttgccacaatgacagagtgtatcctttaaatcattactcaagaatcatttgaaaagatagttccagaaaagagcctccctctgttacccaggctggagtgaaatggcgtgatctcggctcactgcaaccttcgcctcctgggttcaagcgattctcctgcctcagccgcccagatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggt

SEQ ID NO: 130244 - DNA, 2139 bp, Homo sapiens
  Payload ID: 5485
  Gene Symbol: ESRP1
  Gene Name: epithelial splicing regulatory protein 1
  ENST ID: ENST00000517610
  CDS Start-End: 1-1569
gaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaa

SEQ ID NO: 130245 - DNA, 3068 bp, Homo sapiens
  Payload ID: 5485
  Gene Symbol: ESRP1
  Gene Name: epithelial splicing regulatory protein 1
  ENST ID: ENST00000519505
  CDS Start-End: 1-1507
cttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 130246 - DNA, 764 bp, Homo sapiens
  Payload ID: 5485
  Gene Symbol: ESRP1
  Gene Name: epithelial splicing regulatory protein 1
  ENST ID: ENST00000520385
  CDS Start-End: 693-764
attggccaactgccttggagccatttcagtcctccgcaacttagctcaggtggagaggccggcgctaccgagccgggttctttgcccgtcgggggacgctccgccgagacgaggtggggtctcggaggccccggggtccacttccagggcttttccgacctatcgggtggggggtggggcggggggcaggaacgcaccggaaccgatggcgagtcgagagctttgattctgcgtccggaccccaagagaggcgcgggccgccccagcaggggagcgagggaggagggtgcagaaagaggctccgaaattgggggaaactgacccgtgcttctctaccttcggaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatg

SEQ ID NO: 130247 - DNA, 3793 bp, Homo sapiens
  Payload ID: 5486
  Gene Symbol: ESRP2
  Gene Name: epithelial splicing regulatory protein 2
  Uniprot ID: Q9H6T0
  ENST ID: ENST00000473183
  CDS Start-End: 540-2693
cctttgacttccatcaaccccagacctgccgtgttgacccccacagcccctagactgcctcctggtgacttccatactggagaaggcctctgtcttgcacgctcctttgcagaggcctgacgacccctggggaagagtggggggagagcggaagaatgggttagcccccaaaatcaggcaggaccagccctggaagtaggaatccggatcctaagcgtgcgcccaggccgggagcgtgagctcttgcgtcctgggttgagttctggcggccctcccccaaggttcccggagccgccccggtcacgtggccggcggggccggcaggtaactcgcctggagagggcgtgggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaag

SEQ ID NO: 130248 - DNA, 3386 bp, Homo sapiens
  Payload ID: 5486
  Gene Symbol: ESRP2
  Gene Name: epithelial splicing regulatory protein 2
  Uniprot ID: Q9H6T0
  ENST ID: ENST00000565858
  CDS Start-End: 88-2271
aagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgctctgacagcactgtgccctgcccctacagcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaa

SEQ ID NO: 130249 - DNA, 478 bp, Homo sapiens
  Payload ID: 5486
  Gene Symbol: ESRP2
  Gene Name: epithelial splicing regulatory protein 2
  ENST ID: ENST00000562724
  CDS Start-End: 349-478
aatggagcagtcacctcgcgaaggtggcttccgggaagagcgggcgtcgagactcaggctgaagaggaaaaagggcctagaggctgcacagatgaggtcgccaggaggggcgagaaggagaccgagtagcgcccagaccttcgggcggggacgctgtgaccctgtgctgtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatc

SEQ ID NO: 130250 - DNA, 2072 bp, Homo sapiens
  Payload ID: 5486
  Gene Symbol: ESRP2
  Gene Name: epithelial splicing regulatory protein 2
  ENST ID: ENST00000566774
  CDS Start-End: 1-197
gtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaa

SEQ ID NO: 130251 - DNA, 592 bp, Homo sapiens
  Payload ID: 5486
  Gene Symbol: ESRP2
  Gene Name: epithelial splicing regulatory protein 2
  ENST ID: ENST00000564382
  CDS Start-End: 346-592
aagagcgggcgtcgagactcaggctgaagaggaaaaagggcctagaggctgcacagatgaggtcgccaggaggggcgagaaggagaccgagtagcgcccagaccttcgggcggggacgctgtgaccctgtgcttttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctg

SEQ ID NO: 130252 - DNA, 3114 bp, Homo sapiens
  Payload ID: 5487
  Gene Symbol: EPSTI1
  Gene Name: epithelial stromal interaction 1 (breast)
  Uniprot ID: Q96J88
  ENST ID: ENST00000313624
  CDS Start-End: 85-1008
ggaatcccatcttgagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtataaatgggtcatttttatttttaatgaaaagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtagcagacattttagtgtggtggtgtgcagccatttcggccctacacctgccagcctggctaccttacagttgtgttccgatttttgcgtctatgcttggtgtgcctcacttgctgcattttccagcatgcaaccaggagttgacgtaggaaaaagggatgctttcttactttggaagctctcagggaagttggtgtcaatttctcctccactgcctggcctaccctgcactcccaaagattttgtgcagatgggtagttccattttttaaaaattgtgcagatatggaaaattgtgacttacttcatgaccagaactatctagaatatgtgtgggggtataaacatcttgcttaaccaaatatctatgtaggcagaggtaaccaggagagaagcaagacttgctgcctaaaggagcccaccattttacttttcacatttaatctgccacgttgaatcaattggaataaaacctgactcgcaggtgactggacaggaaatcccaaagttccaccatttctatgcttaattttaatgtccccccgcttttttttttgtagaaaataaaaacaagaaaatcgttccaatgtaagatgtttgttatagaaactttaggcaatacaggtgtgtaataaaatgtttaataaacttctaaacacttttgtatttggattta

SEQ ID NO: 130253 - DNA, 3160 bp, Homo sapiens
  Payload ID: 5487
  Gene Symbol: EPSTI1
  Gene Name: epithelial stromal interaction 1 (breast)
  Uniprot ID: Q96J88
  ENST ID: ENST00000313640
  CDS Start-End: 66-1298
cgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatggaaacttcctatcctgcctagggatcacagctgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggttctctattagttttttcgaggcacctaagggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtataaatgggtcatttttatttttaatgaaaagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtagcagacattttagtgtggtggtgtgcagccatttcggccctacacctgccagcctggctaccttacagttgtgttccgatttttgcgtctatgcttggtgtgcctcacttgctgcattttccagcatgcaaccaggagttgacgtaggaaaaagggatgctttcttactttggaagctctcagggaagttggtgtcaatttctcctccactgcctggcctaccctgcactcccaaagattttgtgcagatgggtagttccattttttaaaaattgtgcagatatggaaaattgtgacttacttcatgaccagaactatctagaatatgtgtgggggtataaacatcttgcttaaccaaatatctatgtaggcagaggtaaccaggagagaagcaagacttgctgcctaaaggagcccaccattttacttttcacatttaatctgccacgttgaatcaattggaataaaacctgactcgcaggtgactggacaggaaatcccaaagttccaccatttctatgcttaattttaatgtccccccgcttttttttttgtagaaaataaaaacaagaaaatcgttccaatgtaagatgtttgttatagaaactttaggcaatacaggtgtgtaataaaatgtttaataaacttctaaacacttttgtatttggattta

SEQ ID NO: 130254 - DNA, 957 bp, Homo sapiens
  Payload ID: 5487
  Gene Symbol: EPSTI1
  Gene Name: epithelial stromal interaction 1 (breast)
  Uniprot ID: Q96J88
  ENST ID: ENST00000398762
  CDS Start-End: 1-957
atgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatggaaacttcctatcctgcctagggatcacagctgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatga

SEQ ID NO: 130255 - DNA, 561 bp, Homo sapiens
  Payload ID: 5487
  Gene Symbol: EPSTI1
  Gene Name: epithelial stromal interaction 1 (breast)
  ENST ID: ENST00000537828
  CDS Start-End: 327-561
gtcaacaagaaatgtgatatggggtagaaggttcaaattctgcctctaggtaggagcaagcctacgtcccagcaagactcgcagataaactagcctcttacaaccagaggagtggagctgagagagtgaggagcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtg

SEQ ID NO: 130256 - DNA, 574 bp, Homo sapiens
  Payload ID: 5487
  Gene Symbol: EPSTI1
  Gene Name: epithelial stromal interaction 1 (breast)
  ENST ID: ENST00000538562
  CDS Start-End: 71-313
agactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgttgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaata

SEQ ID NO: 130257 - DNA, 8126 bp, Homo sapiens
  Payload ID: 5488
  Gene Symbol: EPM2AIP1
  Gene Name: EPM2A (laforin) interacting protein 1
  Uniprot ID: Q7L775
  ENST ID: ENST00000322716
  CDS Start-End: 92-1915
agagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaatatttgtgtagtgttttacaatttttgaagctctttcacagtcttatttgaccttcacagtcattctgccttagactgtccattgggtaacttttatccacatattactaattgaaaaatgaagacaagttctttgtaactagggacctcgttgtattctcagaatttagtgtagtgcttagcatgtgacttaaatatgtattatgtgactgttaaacaaattgtggttttctctgttgtatgaaaggagagaaggataacaaattgcggttttccctggtaaacacagtaagtagtaaactcaggattcaaaaccaaatatacacaccaaatccactatgtaatattaagtttgcatatccatgtatagaatcttatttttttttaccctttgtaaacagtgtcatatatatatatatattttttttttttttttaaatttccaaaggaacctacatatagagggaaaagattagacaactacttagtgaactaaaacaatatgtttttactaaatgttacatttagtattggaaaaagataatgccgcctaagagttaataatcatttttccttttgtaggcatcaacactaggagaaaatggcatgctatttacttgctactttcctttacagatgatttttggctcttctgggatttaaaagtaagtaaatttaacaaagtagaagactgactcagcccttctggtcactatatattcagttcacttgtttttacacctgcagaatgtccttatcacccaaagggagatgacccaaaagtgacatctagttaatgtatacttctaaagtttgctgtattcctttgccttcttgttcccatgcctctctgaacttaatttctgggtaactgaggcttttcaggcttaggtgggaaagccacacccttagtctgtttccttaagccattttgaccaatttatgggattaactagtataatcttagttggagttttagtctgaggcatattaagtcattcagagatcttaacagtaggtgtcatagtcatccagtgatttggtgcttgctgcaaaactggcttttttttttttttttttttttgaggcggggtctcactttgtcacccaggctggagtgcagaggtacaatctcagctcaatgcaatctctgccttcctggctcaagcaattctcccactgcagcctcctaagtagctgggaatacaggtatacacgagtacacccagctaatttttgtatttttatgtggagacagggtcttgctgtattccccaggctagtctcgaattcctggactcaagcagtccgcccgcctcgggctcccaaaatgttggtgttatacgtgtgagcctctgcacccggcggcaaaactggcttttaatcaaccttttggctaaaggatttctctttttatttatttgtaaaaggatttcccatttttatctttctttttgatattaaaatgttgcctcatcctacccagtaagtacttgaatttgaattctcttccttttcatttttgcctgcaaactgaccagtcttttctgagttcatctcttctgtacgttttgtcaagtgcagtgaacagcaactacaaaatattttgtttttctgtctttttctttagtaaagggtagatgatctgcctttcaggttatctcaaggggcagtttcacctttccataatataaattacccttgtgtaagttatttcttccatcttctgatagcaatttcctgaatgcctgccagctaaccattaagccagtgttcagtattttagcattttaaaaaacaagggaccaatttctgtgtcagcatgggctagcttgccattgaataacaaaggcaaaatctcactgtctcacacaacttttctattgcaacttgcctagggactttggtttagatcataggttggccatgatcaaactatggtccatgggcaaaatctgtctagctccttatttatctaaataaagttttactggaatatagccttgtccatttatttattatctgtggctactttggttctacaatggcacagctgagtagttgctacagagtgtgtacatctcacaaaacctaaaatacttattctgtggccctttacagagaaagttcaccaatttgtgctctaagttgccttcattctgggtctcaggctgacaaagcagataccatcaggagtgtgggtgctaactttgggaaatgaaaaaagagtatggcaaatcacttaaggactcttaaaggactttcattggccaaagcaaatcacatagccacattaaagttctaggaggagtgtgatccttgcatatacctgggagaaaaaccagaaatatttggaagacaacaccactgattaacatcttcatttatatgctttcttccaatatattttcaacttgttactgaggtaaaatttaaaagtgtaccgatattaagtgtacacctcagtgggtttttatatatgcccttgaatgcaccacccaggtcaaaatatagaatatttctagcacttcagtaggtgtccttatgttccccaggcccccaccaaccccttttatcaccacggattagttttgcctgttttaaaactttatgtaagtgaaataattatatgcactcttccgtgtcttgttcaacattgtatctgtgagagtaatccatgttatatgtagtagcagttcatgttttacttctgtgtagtattccattgtgtgactacatcacaacttacccattctaccgttgatagaaatttaggttgtttccagcttgtggtcattatgaataaagttactatgaaaatga

SEQ ID NO: 130258 - DNA, 513 bp, Homo sapiens
  Payload ID: 5488
  Gene Symbol: EPM2AIP1
  Gene Name: EPM2A (laforin) interacting protein 1
  ENST ID: ENST00000624586
  CDS Start-End: 1-418
caactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgaacacaagtttggccctatcaaaaacgatgaggaaaaaagattgcactccaggattaggaggtgtgagatattttagcttttttgtcttatctgcgtgggtattgctgctttattttaaaaaatcc

SEQ ID NO: 130259 - DNA, 543 bp, Homo sapiens
  Payload ID: 5488
  Gene Symbol: EPM2AIP1
  Gene Name: EPM2A (laforin) interacting protein 1
  ENST ID: ENST00000623924
  CDS Start-End: 1-127
cgtagctacccgcgaacgcgacgtcaggcgccactacgaggctgagcacgaatactacgagcgacacaagtttggccctatcaaaaacgatgaggaaaaaagattgcactccaggattaggagatgatttttggctcttctgggatttaaaagtaagtaaatttaacaaagtagaagactgactcagcccttctggtcactatatattcagttcacttgtttttacacctgcagaatgtccttatcacccaaagggagatgacccaaaagtgacatctagttaatgtatacttctaaagtttgctgtattcctttgccttcttgttcccatgcctctctgaacttaatttctgggtaactgaggcttttcaggcttaggtgggaaagccacacccttagtctgtttccttaagccattttgaccaatttatgggattaactagtataatcttagttggagttttagtctgaggcatattaagtcattcagagatcttaacagtaggtgtcatagtcatccagtgatttggtgcttgctgcaaa

SEQ ID NO: 130260 - DNA, 1660 bp, Homo sapiens
  Payload ID: 5489
  Gene Symbol: EPHX1
  Gene Name: epoxide hydrolase 1, microsomal (xenobiotic)
  Uniprot ID: P07099
  ENST ID: ENST00000272167
  CDS Start-End: 81-1448
gaaaactagccgaggagagccagggagccggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactct

SEQ ID NO: 130261 - DNA, 1780 bp, Homo sapiens
  Payload ID: 5489
  Gene Symbol: EPHX1
  Gene Name: epoxide hydrolase 1, microsomal (xenobiotic)
  Uniprot ID: P07099
  ENST ID: ENST00000366837
  CDS Start-End: 197-1564
acaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaa

SEQ ID NO: 130262 - DNA, 567 bp, Homo sapiens
  Payload ID: 5489
  Gene Symbol: EPHX1
  Gene Name: epoxide hydrolase 1, microsomal (xenobiotic)
  ENST ID: ENST00000445856
  CDS Start-End: 84-567
gctgaaaactagccgaggagagccagggagccggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 130263 - DNA, 895 bp, Homo sapiens
  Payload ID: 5489
  Gene Symbol: EPHX1
  Gene Name: epoxide hydrolase 1, microsomal (xenobiotic)
  ENST ID: ENST00000448202
  CDS Start-End: 488-895
cgcgcctgccgccgccggagcctgcgagccgagaccgtaagcgcccggggccggccgggcccgcactccccggacgcagacgcggttcgggctccgcgcgggctcggccgccggggtgggcggcgggccggggcgccgaggggtcggggctgcggtcggcccgcaggggtgcagagggacttgtagttggtccgcccccagctcctgccccggccaggagactgcgcgtgccgcctactgggggaaggagcctgcaggcgaccgcggacttctcgcagggaattccgcgtcccagactgtgggcggacgccgcagggagggaggctcgcgaccccgagagcgcaccgcgtcccctggcctgggcgagctctgcttccagggccgtggctcgctcggcggtgaaatgcacttaatttgtcacccaagtcggaacactgattttcatgcgcgtccgtgtgaagagaccaccaaacaggctttgtgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 130264 - DNA, 1789 bp, Homo sapiens
  Payload ID: 5489
  Gene Symbol: EPHX1
  Gene Name: epoxide hydrolase 1, microsomal (xenobiotic)
  Uniprot ID: P07099
  ENST ID: ENST00000614058
  CDS Start-End: 210-1577
ggaattccgcgtcccagactgtgggcggacgccgcagggagggaggctcgcgaccccgagagcgcaccgcgtcccctggcctgggcgagctctgcttccagggccgtggctcgctcggcggtgaaatgcacttaatttgtcacccaagtcggaacactgattttcatgcgcgtccgtgtgaagagaccaccaaacaggctttgtgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactct

SEQ ID NO: 130265 - DNA, 2064 bp, Homo sapiens
  Payload ID: 5490
  Gene Symbol: EPHX2
  Gene Name: epoxide hydrolase 2, cytoplasmic
  Uniprot ID: P34913
  ENST ID: ENST00000380476
  CDS Start-End: 165-1673
aggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatg

SEQ ID NO: 130266 - DNA, 1959 bp, Homo sapiens
  Payload ID: 5490
  Gene Symbol: EPHX2
  Gene Name: epoxide hydrolase 2, cytoplasmic
  ENST ID: ENST00000518379
  CDS Start-End: 18-1589
gctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgcc

SEQ ID NO: 130267 - DNA, 935 bp, Homo sapiens
  Payload ID: 5490
  Gene Symbol: EPHX2
  Gene Name: epoxide hydrolase 2, cytoplasmic
  ENST ID: ENST00000521684
  CDS Start-End: 1-935
tgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagg

SEQ ID NO: 130268 - DNA, 1600 bp, Homo sapiens
  Payload ID: 5490
  Gene Symbol: EPHX2
  Gene Name: epoxide hydrolase 2, cytoplasmic
  ENST ID: ENST00000517536
  CDS Start-End: 85-1203
aagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 130269 - DNA, 3140 bp, Homo sapiens
  Payload ID: 5490
  Gene Symbol: EPHX2
  Gene Name: epoxide hydrolase 2, cytoplasmic
  Uniprot ID: P34913
  ENST ID: ENST00000521400
  CDS Start-End: 431-2098
attccaagtccagcaagttcgcagggagctgtcagtccgtccaggaaggcccgggcctgggtttgcctcttcaagcagctactgcaggggcgtggggagggggcataagagactttggactttcctttgagacagtagaaagcgttacatccagaggcgagattctagcctggggtccccgccttcccggcctcctcttcctctccctctgactccctttcctgtgcccctccccctgcctctttcccggccagagtccagccttaacccgggcagagggcggagtcccgttaagggggtgtggggaggaggcggggccagggcaggggcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatgctgctggctgtctttgttcttggagaggtggagtgactgttcacggagaatgcacggcatggggatgaaccctttccctctgcttttgagccctgttctgggctccaaggtgctgtatgatctaggccgtgctggccaggagacaatcctatggggatggcagtggtgtcttgtgctctgtcccctagagcagtcactggccacaggtagccacctgcctttctcccggcttccctagcagagtttgctcaggcacaaatgtgcacctggagcatttgaaatgtgctagtgaggctgaggaagagaattttaaatttcattgaattgtaatcagtttaaagttaaatagcagcagctgccatgaggctcaggcagatccagctcatcttcccctctgccccctcctccctatcttcccctctaccctctcctgcctcctgtcacatccggttaggctcccatctcactgatgtgtctcctgcagtggtctctcccctgccctgcttccagccccagagtcctggagcagcagcctcctcacgggtcttgccgcccacatggttggatcctgaaactcgcagggcctcccccaactgcccctgcccacccccagcccggccccatcaccctccaattcctaaccgc

SEQ ID NO: 130270 - DNA, 2038 bp, Homo sapiens
  Payload ID: 5490
  Gene Symbol: EPHX2
  Gene Name: epoxide hydrolase 2, cytoplasmic
  Uniprot ID: P34913
  ENST ID: ENST00000521780
  CDS Start-End: 172-1641
cttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 130271 - DNA, 574 bp, Homo sapiens
  Payload ID: 5490
  Gene Symbol: EPHX2
  Gene Name: epoxide hydrolase 2, cytoplasmic
  ENST ID: ENST00000518328
  CDS Start-End: 100-574
tccaagtccagcaagttcgcagggagctgtcagtccgtccaggaaggcccgggcctgggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatgg

SEQ ID NO: 130272 - DNA, 1822 bp, Homo sapiens
  Payload ID: 5491
  Gene Symbol: EPHX3
  Gene Name: epoxide hydrolase 3
  Uniprot ID: Q9H6B9
  ENST ID: ENST00000221730
  CDS Start-End: 222-1304
cctgtcgcgcccaggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcagcttaaatgtatgttaattgaaatgaaatacaatgaaaatgcagtgctcagtccca

SEQ ID NO: 130273 - DNA, 1771 bp, Homo sapiens
  Payload ID: 5491
  Gene Symbol: EPHX3
  Gene Name: epoxide hydrolase 3
  Uniprot ID: Q9H6B9
  ENST ID: ENST00000435261
  CDS Start-End: 174-1256
ataagccaggcccaccattccaactctttctcctttttggcttgtaggccgcacctactctgcatatgccccgcccctcactccaggtgtcgcccacttaactgaagatccaggatcccctccttaaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcagcttaaatgtatgttaattgaaatgaaatacaatgaaaatgcagtgctcagtc

SEQ ID NO: 130274 - DNA, 550 bp, Homo sapiens
  Payload ID: 5491
  Gene Symbol: EPHX3
  Gene Name: epoxide hydrolase 3
  ENST ID: ENST00000594042
  CDS Start-End: 174-550
ataagccaggcccaccattccaactctttctcctttttggcttgtaggccgcacctactctgcatatgccccgcccctcactccaggtgtcgcccacttaactgaagatccaggatcccctccttaaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgt

SEQ ID NO: 130275 - DNA, 1805 bp, Homo sapiens
  Payload ID: 5491
  Gene Symbol: EPHX3
  Gene Name: epoxide hydrolase 3
  Uniprot ID: Q9H6B9
  ENST ID: ENST00000602233
  CDS Start-End: 211-1293
acccgccgttggaaccacagctgggtgaagtcagtgctgctaggtctttggagccagaccgaagggagggtcgcgcgcccctgggccgcacctactctgcatatgccccgcccctcactccaggtgtcgcccacttaactgaagatccaggatcccctccttaaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcagcttaaatgtatgttaattgaaatgaaatacaatgaaaatgcagtgctca

SEQ ID NO: 130276 - DNA, 1437 bp, Homo sapiens
  Payload ID: 5492
  Gene Symbol: EPHX4
  Gene Name: epoxide hydrolase 4
  Uniprot ID: Q8IUS5
  ENST ID: ENST00000370383
  CDS Start-End: 99-1187
ggcgcgcgtcgagaggcgacggcgggctggcctggcgcgctgcggcgctcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataaaggatattttagattctttagggtatagcaaatgtgttcttattggccatgactgggggggcatgattgcttggctaattgccatctgttatcctgaaatggtgatgaagcttattgttattaacttccctcatccaaatgtatttacagaatatattttacgacaccctgctcagctgttgaaatccagttattattacttcttccaaataccatggttcccagaatttatgttctcaataaatgatttcaaggttttgaaacatctgtttaccagtcacagcactggcattggaagaaaaggatgccaattaacaacagaggatcttgaagcttatatttatgtcttttctcagcctggagcattaagtggcccaattaaccattaccgaaatatcttcagctgcctgcctctcaaacatcacatggtgaccactccaacactactactgtggggagagaatgacgcattcatggaggttgagatggctgaagtcacaaagatttatgttaaaaactatttcaggctaactattttgtcagaagccagtcattggcttcagcaagaccaacctgacatagtgaacaaattgatatggacatttctaaaagaagaaacaagaaaaaaagattgacttttctttatcttctatgaagggtctgtaatgaaatctctaaataatttttaaaaattgttcatcaacttctttatgttttattagaaaaaaactgttttaatgtgctttatcataaataaatatcctgacaaatggtattgaaaaaaatctgagatcatgtgaacatataatacaatgttgattttcttctggtgtattttgcacagacaagcatctgccttaaaatatatacacttgtacaaaaagg

SEQ ID NO: 130277 - DNA, 1156 bp, Homo sapiens
  Payload ID: 5493
  Gene Symbol: EPPIN-WFDC6
  Gene Name: EPPIN-WFDC6 readthrough
  Uniprot ID: O95925
  ENST ID: ENST00000504988
  CDS Start-End: 70-609
tatatccaaggtgcagcagctgagcattccaaattcgggaaccaccagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccaggacaacaagaagtgttgtgtcttcagctgcggaaaaaaatgtttagatctcaaacaagatgtatgcgaaatgccaaaagaaactggcccctgcctggcttattttcttcattggtggtatgacaagaaagataatacttgctccatgtttgtctatggtggctgccagggaaacaataacaacttccaatccaaagccaactgcctgaacacctgcaagaataaacagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggcctctctgtctacataaatccaggatgccttccctgaccaccttagaccgcctacactctttcttctctgcccatattattgagctctaaagaagatcatcaaggaccattcgttcattctattcattcaacaaatattgattggtgcccctgacacccatgatgggttccacttgctcattgtggccaggaaggtcagaaaagtttttctgggaaagagatccatgatttaagatctgaaagatgagtacttagaccaaaaatgggaagaaatagcctttcaggccagataataggatgtgcaaaggctctgtggcaggaggcaggatgttcaggtctagaaaggctagaaagcagagagtgagcaagagacaagaaacaggaaactggtagtgtatattcagggcaacttgaatctgtattcccaagtggccatcctcaagttttggggtcaaataaatgccctacttaatgatattttctgaatcttgttactttaggttgacatacctttcaagacaataactaggttttcagtgctttgataaaacctcaaatgtgtgg

SEQ ID NO: 130278 - DNA, 2536 bp, Homo sapiens
  Payload ID: 5494
  Gene Symbol: EPS8L1
  Gene Name: EPS8-like 1
  Uniprot ID: Q8TE68
  ENST ID: ENST00000201647
  CDS Start-End: 57-2228
gcagagcctgagcaggcagggcacctccaggtgggcaggagctaccactcagcaccatgagcaccgccacaggcccagaagctgccccaaagccaagcgccaagtctatctatgagcagaggaagcgttactccacagttgttatggctgatgtatcccagtacccagtcaatcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagc

SEQ ID NO: 130279 - DNA, 2198 bp, Homo sapiens
  Payload ID: 5494
  Gene Symbol: EPS8L1
  Gene Name: EPS8-like 1
  Uniprot ID: Q8TE68
  ENST ID: ENST00000245618
  CDS Start-End: 103-1893
agagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgaggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgctt

SEQ ID NO: 130280 - DNA, 2360 bp, Homo sapiens
  Payload ID: 5494
  Gene Symbol: EPS8L1
  Gene Name: EPS8-like 1
  ENST ID: ENST00000540810
  CDS Start-End: 147-2126
agagcctgagcaggcagggcacctccaggtgggcaggagctaccactcagcaccatgagcaccgccacaggcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcaga

SEQ ID NO: 130281 - DNA, 2343 bp, Homo sapiens
  Payload ID: 5494
  Gene Symbol: EPS8L1
  Gene Name: EPS8-like 1
  ENST ID: ENST00000587786
  CDS Start-End: 145-1431
aggaattagaggctcctactggccaggccttcacatgtttgctggctcccagggcacctccaggtgggcaggagctaccactcagcaccatgagcaccgccacaggcccagaagctgccccaaagccaagcgccaagtctatctatgcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatgggtgggtgagatggtgatggggcgggccggggctgggagagagggaggagcagggtgggagggggcgggacccagacttctggggctaagggagttgggaatggagacccggattcctgggcctaagggaggaagggggctgggagtgggtaaagtctgagaggttggatccctggatccccaaaaggctggaagaagccagtttgttttcccagggcctgggaagcaccatgcctgggctccctaggaggacagagccctggatattggaggggagaggctggggaattggacctttgggttttgaagaagagcccaagtctggtgcttgggatcctggagacccagaggagcaggcttgggacttcaagggcttgggggcaagtttctgggaaagttaggaagtggtagtatctctgggcccccgagaggggtaaaggctggacgattaaactcttggttttccagaggctctaatgcaattgtctaagtcgctgctgggtgtcggactgggttaaaaggtttgagggttaaaaggataagattgaagcttgagacctggactcctaggtccctgggggaggaaagaacattccaagtcatggttctaccaagcagtgggggctcagactctgggtcctgggggagggaaggaggtagatggactagaactctagggtccttgagcaaatagagggcagactggagggaagcaacgtgggaggagacgaaaacaaagcagtgaggctggaggagacaaaggggggtctgggtgagggcccgagcagagggtctcagcagggacagcgtgctgggagctgccggccccacacagggggtgccgcggccctgaagaccccccctctcccctgcacagtcaccgagacttggagccagaatctgagcctcagctggagtcagagacagca

SEQ ID NO: 130282 - DNA, 1407 bp, Homo sapiens
  Payload ID: 5494
  Gene Symbol: EPS8L1
  Gene Name: EPS8-like 1
  ENST ID: ENST00000588359
  CDS Start-End: 103-1332
agagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgaggtggggttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcgg

SEQ ID NO: 130283 - DNA, 2130 bp, Homo sapiens
  Payload ID: 5494
  Gene Symbol: EPS8L1
  Gene Name: EPS8-like 1
  ENST ID: ENST00000586329
  CDS Start-End: 179-1825
ccagaacacccctatcttctaggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgctt

SEQ ID NO: 130284 - DNA, 3148 bp, Homo sapiens
  Payload ID: 5495
  Gene Symbol: EPS8L2
  Gene Name: EPS8-like 2
  Uniprot ID: Q9H6S3
  ENST ID: ENST00000318562
  CDS Start-End: 255-2402
tcgggtgactccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 130285 - DNA, 582 bp, Homo sapiens
  Payload ID: 5495
  Gene Symbol: EPS8L2
  Gene Name: EPS8-like 2
  ENST ID: ENST00000531348
  CDS Start-End: 298-582
gctctggggcttggtgggggcaatccctgcgtccggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtcagtctccaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcag

SEQ ID NO: 130286 - DNA, 474 bp, Homo sapiens
  Payload ID: 5495
  Gene Symbol: EPS8L2
  Gene Name: EPS8-like 2
  ENST ID: ENST00000534755
  CDS Start-End: 236-474
gagacctggcgccccggccgaggcgcgaacagacggacgcaccggcgagcgccgaggggacaggccgagcgcggggcgccggaggcagtccctcccctaggcttggctgctgccaggggttctgcgctggccacctggccgcatccctgccctcgaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgca

SEQ ID NO: 130287 - DNA, 704 bp, Homo sapiens
  Payload ID: 5495
  Gene Symbol: EPS8L2
  Gene Name: EPS8-like 2
  ENST ID: ENST00000530452
  CDS Start-End: 1-418
gcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacat

SEQ ID NO: 130288 - DNA, 3844 bp, Homo sapiens
  Payload ID: 5495
  Gene Symbol: EPS8L2
  Gene Name: EPS8-like 2
  ENST ID: ENST00000526909
  CDS Start-End: 144-251
cgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttggtgagtgaggtttgagaacgggctggacgtcacaggggagaaatgggcactgcatccaggtgggggacagctgctcctgccccacagctgtgcctggtctggcccaggggatctccgggtgcccagggaggcctctggaccctaatcaaccttccgaaagctcctggccactggatcccctcccccacacccgtaaggggagaggcctttactaataattcagggagcatcaatattgattccgctgcactcattgctgtaacctgatcacagcgaggttcaggcaggataagccgccaggtgtctgctccaggaggggggcctggccagcccccacctccccccactctgcccttccccagagacgaccctgccctctcgctagctagatgcacccttcacttatgtctttggacaaggtgcctagtctggaaagcgagaagacctgggagggcagggagagtgaagctggcagctctcagagtgggaagaagccgggctgggacccccttcctgtcccctcaccctccgggacagaaaccccccgggcacaggctgctggtccccactccactcagagcaagcccatcgccttctccgagctgcgtccttctccaagggggcttccctggagggagggagggggcttcctgcaggtcctgatttcacacccacatccttcctggtggccaagaggtccacggagcagcctccctccgcttgactccaccttcccttgtgggtccagtcccaactggacgggaggctgtgggtcctgcccgtcgggggagtgactggtgtctcccggttcagagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctc

SEQ ID NO: 130289 - DNA, 587 bp, Homo sapiens
  Payload ID: 5495
  Gene Symbol: EPS8L2
  Gene Name: EPS8-like 2
  ENST ID: ENST00000533500
  CDS Start-End: 337-587
acgcaccggcgagcgccgaggggacaggccgagcgcggggcgccggaggcagctctggggcttggtgggggcaatccctgcgtccggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaa

SEQ ID NO: 130290 - DNA, 580 bp, Homo sapiens
  Payload ID: 5495
  Gene Symbol: EPS8L2
  Gene Name: EPS8-like 2
  ENST ID: ENST00000524763
  CDS Start-End: 265-580
atttgtggcaggtggggcaggctggtcacctggagcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggaca

SEQ ID NO: 130291 - DNA, 3266 bp, Homo sapiens
  Payload ID: 5495
  Gene Symbol: EPS8L2
  Gene Name: EPS8-like 2
  Uniprot ID: Q9H6S3
  ENST ID: ENST00000533256
  CDS Start-End: 376-2523
gtgactccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctccca

SEQ ID NO: 130292 - DNA, 2469 bp, Homo sapiens
  Payload ID: 5495
  Gene Symbol: EPS8L2
  Gene Name: EPS8-like 2
  Uniprot ID: Q9H6S3
  ENST ID: ENST00000530636
  CDS Start-End: 252-2399
ggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttata

SEQ ID NO: 130293 - DNA, 2289 bp, Homo sapiens
  Payload ID: 5495
  Gene Symbol: EPS8L2
  Gene Name: EPS8-like 2
  Uniprot ID: Q9H6S3
  ENST ID: ENST00000526198
  CDS Start-End: 41-2236
gaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacagagtgcccagaccccgggtgcgagtcgtgtccgcgcgatgtacccgcaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcat

SEQ ID NO: 130294 - DNA, 540 bp, Homo sapiens
  Payload ID: 5495
  Gene Symbol: EPS8L2
  Gene Name: EPS8-like 2
  ENST ID: ENST00000527199
  CDS Start-End: 465-540
attcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggcca

SEQ ID NO: 130295 - DNA, 2233 bp, Homo sapiens
  Payload ID: 5495
  Gene Symbol: EPS8L2
  Gene Name: EPS8-like 2
  ENST ID: ENST00000528770
  CDS Start-End: 1-503
agaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcaggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctccc

SEQ ID NO: 130296 - DNA, 3188 bp, Homo sapiens
  Payload ID: 5495
  Gene Symbol: EPS8L2
  Gene Name: EPS8-like 2
  Uniprot ID: Q9H6S3
  ENST ID: ENST00000614442
  CDS Start-End: 248-2443
actccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacagagtgcccagaccccgggtgcgagtcgtgtccgcgcgatgtacccgcaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagg

SEQ ID NO: 130297 - DNA, 1633 bp, Homo sapiens
  Payload ID: 5495
  Gene Symbol: EPS8L2
  Gene Name: EPS8-like 2
  ENST ID: ENST00000610855
  CDS Start-End: 581-1279
cggcccccctctgagggcgagttcatcgactgcttccagaaaatcaagctggcgattaacttgctggtgggtccggtggccccagccctgccccactgtctgtgctgaggggagggtggaggccccgccccgccccggcacctgctcacttgttcccacccccaggcaaagctgcagaagcacatccagaaccccagcgccgcggagctcgtgcacttcctcttcgggcctctggacctggtgcctggggccgggcggcaggggcgcgcagggtgggggcccagaggcctctgcagcatctccccggggtcggggttggggcagcaggtgcccgccttgggcagcccggttcacgctgtgtggccactctccctggggtccaaagtcccttcccgagggccagcctgtggagctacgggggtgctgggccagggtctgtgggcctcagtcccctctgaacctcactgtgccccagatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggcaggccggagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattattttt

SEQ ID NO: 130298 - DNA, 2130 bp, Homo sapiens
  Payload ID: 5496
  Gene Symbol: EPS8L3
  Gene Name: EPS8-like 3
  Uniprot ID: Q8TE67
  ENST ID: ENST00000361852
  CDS Start-End: 128-1819
cactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgt

SEQ ID NO: 130299 - DNA, 1971 bp, Homo sapiens
  Payload ID: 5496
  Gene Symbol: EPS8L3
  Gene Name: EPS8-like 3
  Uniprot ID: Q8TE67
  ENST ID: ENST00000361965
  CDS Start-End: 108-1889
tccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattc

SEQ ID NO: 130300 - DNA, 2325 bp, Homo sapiens
  Payload ID: 5496
  Gene Symbol: EPS8L3
  Gene Name: EPS8-like 3
  Uniprot ID: Q8TE67
  ENST ID: ENST00000369805
  CDS Start-End: 231-2015
gttgagcggttagtgaccaggaagcctccccacccaccagagtccaaagagcacaggcgtggctgcctctgtaacctcatcaaaggcaggctctgcctgtggccactagcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagaggctgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttg

SEQ ID NO: 130301 - DNA, 1806 bp, Homo sapiens
  Payload ID: 5496
  Gene Symbol: EPS8L3
  Gene Name: EPS8-like 3
  ENST ID: ENST00000472325
  CDS Start-End: 124-243
agcagagaagctgctgtccttccaccaccagcaccggaccacctgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacgcctgtggtccacctctctgagctttctcccagtcctaggactccccctctccctgcagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagtccatggtccccttacactgcaggcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggtactacccagcctggactatccagagccctaagtcttgagttggaggtcggggtggggaggattcagtggcaagcagaggagatagtcttggtttgattcggaccgtattattgcatgct

SEQ ID NO: 130302 - DNA, 2355 bp, Homo sapiens
  Payload ID: 5497
  Gene Symbol: EPN1
  Gene Name: epsin 1
  Uniprot ID: Q9Y6I3
  ENST ID: ENST00000085079
  CDS Start-End: 293-1945
cggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggc

SEQ ID NO: 130303 - DNA, 16219 bp, Homo sapiens
  Payload ID: 5497
  Gene Symbol: EPN1
  Gene Name: epsin 1
  Uniprot ID: Q9Y6I3
  ENST ID: ENST00000270460
  CDS Start-End: 312-2042
ctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcactcccagattcccatctgtgatttcgtgtgtcccccagagccccttcatccagggacccagggctcaggtcacatctctttctcgggggtggctggcaaccagcccctctgtctcagaagccctgatttccctgaccctcccaggtcaagggatggctgggttgagggtggactgtgcgaggcctggcggagctgtagcccacacaggtccaggtggtcgggaggccactcatggccagacgcttccggtgcaggaggccttgctcttgtgttgaggggacaccaggatgaggtcagagagtgcactggggttcagggaggagaagaatcctgagagatggcacatgtgcaacacaggtcaccgtcgccatcgcccgggcccaccgcaagcatcactaatccatccctgcactcctggaaagccgggtcagcctctgccggctgagctgagtggaccaccaggcgcctcctggttgtcctctgtgtgctgttttcctctgtgtgctcttgtcctgggctggaccacacctggtgagactatccgggagaatcctcgggccgccttgtgaggggggtgttgctgtcatctccagggctaggtgacagcttgttgcaggccccacagccagggcctcagggatggggatctggccatgtctgttttaagccgaacaggctgttcttccatgtggagtctccctccgtgatcccctggggtcaagtcctgacggctgggttcgctccctcagtgactccgacagctcttgtctcagaggtgctggggtgaaggctgtgtggggccaggcccctggggtcagacttcttgccccttctgcccgggggacgctctgggctcagggtggggccagacagctacatcacagggacacttgttatgggtcggggtccagggagcacccagccagtggagtgttggaggccactgagagggacatgactgcggtgtccgagcagcgtcgtggccaccctgtgtgcccactccctggtggacagacctacgtcacctggggattgcagagcaaaaggagtgctgttggggtgatgtgaggttggggttctgtttcttgctgtgaattgggtcatgacctgtgtcggagcgttctctggcctccacttgcccctgcagaccagggtgtctggagggttgtcgggggcttgatggaggaattgctgaccacaccatgcaggaagaggtgggtcccagggacacaggaactttggggtcagccggttccagattcagttgcagaggagcatcccccttgcttagccagggaggggaagccctcttctcacacccggcctgggtatgttgtgggagagtcatttcccaggaggaaatggggactgttaccgggggagggggtgctgtccccaggcagcagcaagcgtcccttacgcttgggctgtccgagaccctgctgctctaggcggttgtgatgggggagccccacagggcacagagagccagctgaaggcggcagctctgggtgggatcacatggaaaggggaggcgagccgagcctccctcttgccaatcttggtctccccacagggtcatagctcctgggcccctcacttgtcagaccctccattcaccaaattaaggataagtttcacgatttcgcactgcggagcctgcactccctttctcttcaaaaaagctgaggacgaagataaaatgatacagttggattagtccagtggaggggttaaaggtgtgaggctttaattctccccaccatttcctcatttggcaaaacagagaagacaggattgaaaaacaagacaaaaacccagaggcttgcacataaatttggggcttaactacagcatcttcggcatcttcttttccctacagtgcgaattacaaagtagcaccacagatctcgtgtctcctactttattcctctttctagaatattccagccaccaaagtgctcagcaggagctgctgtgtaggagtcccccatgaggcccaagcacctgagcttagtgacatacacggttgaacgctgggagaatgctgggagcctgctgttgtccccgattgagggctccccccactgtgtgtgtatcactctttctacagcagatgtgtctctctccccacagtgggatggcgagcttgttaaatggccgtgaggaagactttattcaggaccatcgagacaggtacaggtaccatcagtggatggaaaatcactaagagcaaacctcaggggtccgggggttttcggctaaacccacctagcaggattcttgctgaaggcaggccagggtgatcagaggtcacctggggatggtggaggctgaagaagcctatcagatgtgagggtggcgggggttgggggggatggcggcggggttcatttgctgaaaggattttacaagggcatgcacggatgggcctaggaggaggttcagatccctcaggtttggctaagcaagagtcatggtggtgctcccggctggctctcaggagcagatgtgcttctgacccgacgtcttcccccagagagggctgaagtggaaaaaaccccagaatttctccctgggacaggtgaagcgatggggcgtgggacattcctgggtctcgactctgttcagggcctaggggttgggtggggaaggcacttgagggaaccttcctggagcccgtaggagcttcatccgagctcctgggtcaccccgcccaccagagtccaggcccaccagagtcccctgccacctgtgctcaccctagccttacccctcgctctactcccgccctcgccctatcctcgctcctcgccctacgcttgcccctcgctctggagctgcgatgccagcctcagggctttcagtcctgccttgatctttttttatactgaaactcaattttacacacacaaacccactcccagccagcctctgccttttgccttttcctcatgttctcattgaataggaagaaatgcccttttttttcccccctagaaggagtcttgctctgttgccaggctggagtgcagtggcacgatctcggctcaccgcaacctccacctcccgggttcaagcgattctcctgcctcagcctctcgagtagctgggattacaggtgcccaccaccacgcccagctaatttttttttgtatttttagtacagacggggtttcaccatgttaggatggtctcgatctcctgacctcgtgatccgcctgcctcggcctcccaaagtgctgggattacaggcgtgagccactgtagcggcccccaccccatttcattttttatttttttattatactttaagttctagggtacctatgcacaacgcgcaggtttgttacatatatatacatgtgccatgttggtgtgctgcacgcattaactcgtcatttacattaggtatatctcctaatgccttccctcccgcctcccccaggcccttagtttgtgctgctctgcgttggttttctgcgtgtgctaaaaggggagggagagtttctgtgcccattcccaggcaccttcttgcagccgcaggcatctcccccacacgtgcttctagcttcccgggtgtggcgtgagccattgcgtccggccagaaatgttttatttcttgagaacttgtctgtctctgtgatgactgtgggttgtccagctcatccctcaagcgccatcctgccaggcccttcactgtggtgagaaaccggcctactcacatcacaggtgcccctggagtttctcaaactgcagcccaaggattggctgcttgcttttgtaaaaaaaaatgttttattagagtgcagccacggctgcttctgcactacagtggcaatggtgacattgagtgtggcagagaccgagtgtcccttgagcctaaaatatttactatctggctcttcaacaaaaagtgtgctgacccccggtgattgcttgtatgtggcaggggtctaaggcctgcctgcacgtcctgggacagcccacgcttccacagggttccagcatgctttccgccgagaaatcgctccctttgctgtttgttttgtattgaatgtttcttcatgcttttgttttactttcagggataattatataatgttatgtttcatccacattattttagtatggatatttataatttcctaaagcactattttttttttttgagacagagtcttgctctgtcgcccaggctggagtgcagtggctcgatctctgctcactgcaagctccgcctcctgtgttcacgccattctcctgcctcagcctcccaagtagctgggactacagatgcccaccaccatgcccagctaatttttttgtatttttttagtagagacggggtttcactgtgttagccaggatggtcacgatctcctgacctcgtgatctgcccacctcggccttccaaagtgttgggattacaggcttgagccactgtgcccggcccataaagcactatttaatgactgctccataaatacaaacttcctttccttattattattatttattttttttttgagatggagtcttgctctcgtcccccaggctggagtgcagtggcgcgatctcggctcactgcaacctccgcctcccgggttcaagcgattctcctgacttgggactacaggtgcgtgcgaccacagccaactcatttttctgtttttagcagagacagggtttcaccatattggccaggctggtcgaactcctgaccttgtgatccacccgcctcggcctcccaaagtgctgggattacaggcgtgagccacggcacccggcccataattacaaactttctgagggacatcttgaagcacacaaaactatagacaatattatcataaccacccctgcaaatgcctcactcgtgttcagccatcatttacatttgaaccactcctgtttcacctacagcctcctcatggcccctcccctggagcacttaaaaatggtaatgacatgctctctagtaatcgttgtgtgttactgtcaaaaggtataactcatgcattgatgggggtaacccctacagcagttaaccctgcgtgctcagaggggaatgaaaggtagctcagaggctcgggaggtgaggttgcaaaatggcttgtgttgtggggaatgttctcatccacccaaatcaagcatcactacatccatccgcaggggaggcaagcttagggcatcacgtccaggagtggccaggtcccgatgtcacggggagccgggctgggacaagctccagacggccagggtggtgtgggtttgcagtgggagggctggcgcgggggccctgagggctccctggttcccatcttatcaagatgctggactcggtgcttgaaacatgtcctgacagccacatgaaaagggttagaaatgatactgtttcgcctgggtgctgtggctcatgcttgtaatcctagcactttgggaggccgaggcgggcggatcacgaggtcaggagttcgagaccagcctggccaacatggcgaaaccccgtctctactaaaaatacaaaaattagcctagtgtggtggcgggcacctgtaatcccagctacttaggaggctgaggcaggagaatcgcttgaacccaggaggcggaggttgtagtgagccgagattgcactactgcactccagcctgggtgacagagtgagaccctgtctccaaaaaaaaaaaaaaaatgatactgtttcctgtatttttttctcttagtatcttaagaaatacatgatttgaacaaggaccttgtgtctcctctcccctttcccggactattctgaccccagcagttctcagaaggagctgacattaatgagaacttctccctgttagacccttaaaatactgagctttcgggaccctgcctggcttgttcctgtaaaacggtcttgtctgtggtaaatactaaggtttttggtctcacagccgaggaaatcaaggatgtggatgcacacagagtgagatttggagcaggagtttaataggcaaaaggaagaaacagctctgtcacagagacgggtcccgaacgggttgtgaagttgtagaagaaatgtcaggggttttatagatgggctagtgaggaggggtgtcttttcttcctagggcctgaagaaccagttaggaccaggtgtgctgtctgcatcgagcagagtctctagcagcccccaccccattcttttttttttttttttttttgagatggagtctcgctctgtcgcccaggctggagtgcagtggtgtcatcttggctcactgcaacctccgcctcccaggttcaagcaattctcgtgcctcagcctcccgcgtagtcgggattacaggtgcatgcagccatgcccggctaattttgtatttttagtagagacaaggtttcaccatgttggtcaggctggtctccaactcctgacctcaagtgatccgcctgcctcggcctcccaaagtagtgggattgcaggcgtgagccaccgcgccgggcccccaccccattctttgatcctgcaggcaggcccttcgtttgtgctgctctgcgctgctgcttatctgtgtgtgctaaaaggggagggagtgtttctgtgcccattcccaggcaccttcgtgcagctgcaggcatctcccccacgcgcttccagcttcccttagtgtgcctaaagaaagggaaaggaatgtgctttaggcccactgttttcactggggcccatctatgtatgtggcttggtgattacccaggaacctcccaagtctgtgcccgagttgcttatctgtgttttacagcctgaaagatcaggctgctctttgttaggagaagtgatttctttgaactgcgtggtgtggtgagaaagggagcaatttctaagctgctttttgttaggaagttttttgctggggactctcttcgccctatctacctaaatgatttctgtttcttacatcaattgggtattgatttcaggtagaatgggtgaatgcatttattcgttcatctaagccgcatttactcctttcttttctttcactgttgttttttttttgagacggagtcttgcactgtcacccaggctggagtgcagtggtgcgatctcggctcactgcaagctccacctcccgggttcatgccattctcctgcctcagcctcccgagtagctgggactacaggcgcccaccaccacgcccggctaagctaattttttgtattgttagtagagacggggtttcaccgtgttagccaggatggtctcaatctgaccttgtgattccgcccacctcggcctcccaaagtgctgggattacagccgtgagccaccgcacctggcctctttcagttttgatagcagattatttcctttggccctgcgtggtctctctctggctgggcagctctgggccagccataaatggaggggagggcgtgtgtgtggccacgtgtgtttctgtcctggacaacactgtccggaggggcctaagtgggaagtgccctcaaccaaggagatagctgctgtgtgtgtgtgtgttgtgtgtggttgggacagtcggggattctcacttttttttaaaatttgagatggagtttcactgtcgtcacccaggctagagtgcaatggtgtgatttcggctcactgcaacctctgcctcccgggtttaagcgattctcctgcttcagcctctcaagtagctgggattacaggtgcccgccaccacgcccagctaatttttgtatttttagtagagacggggtttcaccacgttggccaggctggtctggaactcctgacctcaggtgatccacctgcctcggccccccaaagtactgggattacaggcgtgagccactgggcgcagcctgggatcctcactttttcgcagattggtcactagcagggcgtctgatggaactttctgagatgccggaaatgttctctgtgctgtacaaaagggatgccactagccacatgccacgtagaacagttgaaatgtggccagcatgagatttttttaatcttgccaatttttgatggatttaagtttaagcacctgcgtgtgagcggctaccgcgtgggctgggattggaggaagctggaaagcgctcccctgcgtttcggctgctggcccagcagagggcgccggagagcggacggagccgcaggcggggttgtgggaagacgctgggatcccgtgcgcgcttgtgctccttccttctgggccagcgcgcagactatcaaccgaggtattcagtccctcggaaacccagttcctccgtttccaggcttctcgcccacacggagacagtcgctctcacacgtacctctcgcgggctcttactcgtggtcccggtctcctcctggtccccaccttccagcccagcgcgcacactagacggcacgtgctctccacgctctttctccagcgccccttgctcacccgccccccgttggagtggcccatcctctccgcttagacacctgcagtcactgtcactagctgaactgcgccctcctgaaagctctatgttgaaaccctaccccccaccctgcaccgaccccgtaccccagaatggggctgtatttggagacagggcctttacaaggtaagtaaggttaaaatgaggacattagggtgggtcctaatccaatctgactgttatatagtggggttgcaccttcatgtgaggacgccgggagaagacagccgtctgggagccaaggagagaggccttggcggaagccaaccctgcagcaccttcatcttgaatttctggtttccagaactgtgagaaaatccattgacgttctatagcgctcccagctggcggtactttgttatgacagccctaacatgaatgcagccatccacactgtctgggggaaggcacacacaccccacagcacccttgctgtctcaccccgtatcgcaaaagctcacgcatgtgtctctcccgagtccctggagggtcctgccacctacatctctctccttggcctgccgcctgtgatgctcctgggccccctgctccagcaccgctcccttccttctgtaatacagacaacagagacaggagatggcctggccccacttcatttctgttccctgggaaataagcatcgcaagtgatccgtagaatggtagacatcatccacttcccaagcatctctggctgaatgctgttctcatccacttcccaagcatctctggctgaatgctgttctacacatgcacgtgggaggcaccagggagcccagaagaaatgaaaagcctgggcagactcgcagttctgccacacagtgaatgtgctactcaagccactcagcctgggctgcagaggttggaagcctcactggcctgaggtttctgagtaagctctgacccaatcattgactattaaacttcagaggtccatggagacctcttaggagtctttgaaggaacttagcatagataccgatagctgctgactgcagggagatggggagatatgttttgtaaacctgtccaggcaacttttttgcctacggaaacacacaaaaacgaaaacaaaccaatgaaaaaaacctctcagaacgatacagaatccagagccactacaacacatttcatgaagtggcgtgagcctgtaattccagcagtttgggaggccggggcgaatggatgacttgaggtcaggagttcgagaccagcctggccaacatgacaaaatcaccatctctactaaaaatacaaaaattagtcatgcatagtggcatgcacctgtagtcccagctactcgggatgctgagatgggagaatcgtttgagcccgggaggtggaggttgcagtgagccgagatcgcaccattgcactccagcatggacaacagagcaagaccctttcttagaaaaaagaaaagtatccccgaacattatcagagtcaagttaataaaggccaaaggtagagaaaatcttgaaagtatcgagaaaatgacatgtcaatcataaggtcaggttcttcaacagtcatactgacattgtggctggaatatttgttgttgtgggatatatatatatatatatatttagagtgttgtgggatatatatatatatttagagacaaggtcttgctctatcactaaagctgcattgcagtgtgtgatcatagctcaccatgggattcttgattttcagtgagtataaagtgtaagacaaaataagtcttagttcaggtatgctggatgggaagccagaggtctgcatagcagttacaaagaaggccttattatctggaagaaaagggaccatagaatgtccattggttggggaacaacccagctttagtttttccagattctctgcatgtgcaggtttatgagactggagaactttgatttcttcttcctcctcctcctctcttttcttcttcctcttcctcctttttctcctcctttcttcctttatttttctttcttcctttcctcctctttcttctcctttttcctcctcttttcttcctttcttctctttttcttcttcttttttttttttttttaaaagaccgtgtttcgctctgtcacccaggctggaatgcagtggcgtactgttttagaaaagtgaaagagggccgggcgtggtggctcatgtctgaaatcctagcactttgggaggctgaggcgggtggatcacctgaggttgggagttcgagaccagcctggccgacatggcaaaaccctgtctctactaaaaatacaaaaattagccgggcatgatggcagatgcctgtaatctcagctcctcagtaggctaaggcgggagaatcgcttgaacccagaggcagaggctgcagtgagccaagattgcagcattgcaggaaagagagaaaaaggagggaaggggaaggaaaaggaaagaaagaaaagaggggaagggaagggagagatttaaaaaacaatagtaaagagagatttaaaaaacaatagtaaagagagattaaaaaaaaaaagtaaatgggccaggtgcgatggcttgtgcctgtaatcccagcagtttgagaggctgaagtgggaggatcacttgaagccaggagtaccagaccagcctgggaaacatagtgagaccccgtctatactaaaaaatatttaaatgggctgagcgcggtggctcaggcctgtaatcccagcactttgggaggccgaggcaggcggattacctcaggtcaggagtttgagaccagcctgaccaacatggcaaaaccccatctctactaaaaataccaaaacaaaaactagcagggcatggtggcgcatgcctgaaatcccagctactcaggtggctgagacaggagaatcacttgaacccaggagacggaggctgcagtgagccgagattgtgccactgcactccagcctgggcgagcaacagagtgaggctgtctctcaaaaaaaaaaaaaaaggaacggtagtgtgcacctgtggtcccagctacacaggaggctgaggcaggagcatcacttgaacccaggagttcaaggctgcagtgagctatgatggcaccactgccctccagactgagccaaaaagcagaccctgactctaaaacaaaagaaagaacaaataacaaatgaaaataaatacccaaaaaccagtcaaatgtgaaactggtgtcaggggtatgttctccatgttgagccccttctgtggaatatgacagtgtctctatttcgggtaaaggaaagaccaaaataactttccaagatgaaaagctaagagtgctgatctcatcacagacatagccagctcttcagttcagaccacctggaaaccctccccatgtcttttcagaacaatgtcctaagaaccataggggaagtggccataaaaaccatctttcctttgcagactggggtggggactctggccaatgccattctgttcttccataatatctttcccatcttgactgagcatcaaatgaggcccacacacaagattctcacccacatggccgtggcaaactccttggttcttctttccactggaatcccccacacaatggtgtcttttgtcctatggaaacccttgtccagtcttgagtgtaaactcgtgtttacaggtcttaaagtcctgacctggtgatccgcccgcgtggacctcccaaagtgctggaattacaggcgtgagccaccactcctggcctatgccagcattctttaaagttgtgggaaaaggccaaaagcaaatagaaaattgggcaaaaaagttcataattgcttaaacatatggaaaacctggaagtaaaattaagcaagtaagtgcgagcactctacattgaagattatagaaaattcagcctcccaaatatccaaagaatccaggagtgtgccaagagatccaagagtaggtccacaatttctcattctcaggagaatctgagattatatttcaatctaatgataactgattatataatccaatttctgcatcatcttgcttttatgttttgtaataaaaattttagaccaggccaataaggcatcagcaatttaccgtagggaactagggaatgtttaattatgacaatgaagtgtttaatattgtgttttgaaatataaacagtgtagatatatttgaataatactgaatttttagaaaaatctattggggtgtcatatataaaaggataagtagagatttggaaatgcttttttattggacaagaaaattgatcaaatcgaaatctggacaaactagaaagtctggatgctagcaatacaatctatagacacattctagcatcacttctgtgtcagaagtatccggattgtggtgcctacaaatgcatgctcctacacaccaagacatccattaagaaaataaagccatgctttccagagcgtttagcacttgtttaacgtacttgtgcttctaaatatcacaaggcaggatgggatttctaaagacaaggggatataggaccgaggcaaagacaatcagcatgtacactgaatcacactccataatcatattgctagaacacttagggagtacctctgaaatcacagccctgctgccatgatgtgcaattacaggatagaggtgccaggtgaaggtcccactgtggccaaggaaagcctttgtgagacgactacttcagggtgttccccatcagaggagcacacccctgatcttgtattcctcgtcaatccaaggtccatgtgaaatggtcagatggggaattttttcttccacagacatcaggatcttctgagtttcttcatcaaagccagatttgtgcagcctgggaaaatagaaataaagtttttttttttgtttttcatttttacacagtattgcctctctacattctgatgtctacctctcctctcctctttattctttcctagaaatcactgggagaattgtactgaatttgaaaaacaagcatgaatctttcctataggataggaagcctctgatttataccataaagtgaaatttcatatacaggatgtatcaattaagatttaattcaaaaaagatgaatttaagttaaaaagaaaaacacaggataacttccattcatctgatgttcatatgccctggcacatctattgcttcttataatgtgcttgcttaaaaaaaaaaaacatgagcttttctcagagacactaatataatgaattcatgtacccatcaccaacttctacaattaccaatattcagcctcttccatttacaacctgcccattttctaagaaataattaaagcacatgctacacccataaa

SEQ ID NO: 130304 - DNA, 2621 bp, Homo sapiens
  Payload ID: 5497
  Gene Symbol: EPN1
  Gene Name: epsin 1
  Uniprot ID: Q9Y6I3
  ENST ID: ENST00000411543
  CDS Start-End: 548-2536
aattctttcatttcagagttgagcaaactgtgtctcaaggaggtgtgcgctgcaggtagctgatgtggccaggatttgaacccacattttatattctttgccattagattccatttttcttatctcttatttctcagcgccaggtctctttttgtttctgggcctctttcttccttggcctcctgcctccctgtcttcccatgttcttgtatctgctgctgcctgtgtttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggagcccagtctttgcatgcagtgttgaaaaaggtaatgtccctcttgtgctgagcgagcacctggcacacagcagggacccaggcagtggggctgttaggttccttatctctcctgagccttgggcttccgctatccttgggacgtctggtcttctggcttccccggttcttcctgccgccctggatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgg

SEQ ID NO: 130305 - DNA, 250 bp, Homo sapiens
  Payload ID: 5497
  Gene Symbol: EPN1
  Gene Name: epsin 1
  ENST ID: ENST00000589704
  CDS Start-End: 1-182
ccaagcccagcaccaatggcacaacagcagccgggggattcgacacggagcccgacgagttctctgactttgaccgactccgcacggcactgccgacctccgggagcagcgcagcttactggacacgacttcctcctggcttctactccctcaacagctatcgttcttgctttatacgttgaatctctgtctctttataacttctaaatgttctcagcatcaggaaaatataaaaaataagttcacaaat

SEQ ID NO: 130306 - DNA, 4664 bp, Homo sapiens
  Payload ID: 5498
  Gene Symbol: EPN2
  Gene Name: epsin 2
  Uniprot ID: O95208
  ENST ID: ENST00000347697
  CDS Start-End: 449-2203
gcgccccctcccggccgccatgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 130307 - DNA, 4871 bp, Homo sapiens
  Payload ID: 5498
  Gene Symbol: EPN2
  Gene Name: epsin 2
  Uniprot ID: O95208
  ENST ID: ENST00000314728
  CDS Start-End: 485-2410
gggggcggggcctgagggcgcgcgcacgcgtccggcgcgccccctcccggccgccatgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 130308 - DNA, 2216 bp, Homo sapiens
  Payload ID: 5498
  Gene Symbol: EPN2
  Gene Name: epsin 2
  Uniprot ID: O95208
  ENST ID: ENST00000395618
  CDS Start-End: 226-1296
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttattt

SEQ ID NO: 130309 - DNA, 3860 bp, Homo sapiens
  Payload ID: 5498
  Gene Symbol: EPN2
  Gene Name: epsin 2
  Uniprot ID: O95208
  ENST ID: ENST00000395620
  CDS Start-End: 1166-2920
tgttcatttctgtgtcgggcacagtgctaagtgctgggtgctcactggtgatgaggcagatgaaggttaccaaacttgtggacaggagcctcatatcagagacgtggacctcactgtagcctggtaagtgagtgttatctggaggaagagaggggatagatgatgtgtttggttggagcgagttaatagatagccaggggtctcagttttctttgtgaaatgaggggctgggctataaccagattagttttaaggctgtattagcttgggccagatgctggaggcttctgaaagccaagtggaggtctttatcctttttctagaattgctgttaggaatctttataaattcttgaacagggaaggtcaggcgaaaagtggttgtcaaggagaattttctggacattcggaaacacagtggaccaaagcagttttgaaggtattgacaggcatttttgagttaagatagacctgaaattagtctctttcttgtcctcatgtgtatttttttttatttaaataaactttaaaaaaatagagatgggggtattgctgttttgaccaggctggcctcaagtaatcctcccatttcagcttcgcaaagtgctgggattacaggtgtgagccaccatatctggtctcacatgtaattttaaatctgccaagatcagcttcccccagtgtttccgattcttccacagctggcttttgccaggcagtgaaaagacaacccataaaatagccattccagtggaagtgttttgaaaatagagcaatagtcatgatgtttacttcttttctcctaaaggcttaaacttgagtgtaagttttattcattgttgactggtgatattgattttatcttgggttcgtcctaaggaggctgggtatgtccactcagctccccagttttacccagtacctgctgctggaccacagtctcccaccctcacagggggcttacgtcgcagtggaatgggttttctctttctctaggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaac

SEQ ID NO: 130310 - DNA, 2863 bp, Homo sapiens
  Payload ID: 5498
  Gene Symbol: EPN2
  Gene Name: epsin 2
  ENST ID: ENST00000395626
  CDS Start-End: 142-1596
gctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 130311 - DNA, 1657 bp, Homo sapiens
  Payload ID: 5498
  Gene Symbol: EPN2
  Gene Name: epsin 2
  ENST ID: ENST00000395628
  CDS Start-End: 429-1657
tgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttc

SEQ ID NO: 130312 - DNA, 1883 bp, Homo sapiens
  Payload ID: 5498
  Gene Symbol: EPN2
  Gene Name: epsin 2
  ENST ID: ENST00000571254
  CDS Start-End: 74-1807
gggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggat

SEQ ID NO: 130313 - DNA, 1491 bp, Homo sapiens
  Payload ID: 5498
  Gene Symbol: EPN2
  Gene Name: epsin 2
  ENST ID: ENST00000575595
  CDS Start-End: 206-1255
gtcaaactgagccagacgcggcggtggcggcggctccgcgggctacggtcgctcccgcctctcgagcgctgccggtggccgcagcggcgcacccacgccggcccggaggagcagagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggca

SEQ ID NO: 130314 - DNA, 959 bp, Homo sapiens
  Payload ID: 5498
  Gene Symbol: EPN2
  Gene Name: epsin 2
  ENST ID: ENST00000494192
  CDS Start-End: 206-959
gtcaaactgagccagacgcggcggtggcggcggctccgcgggctacggtcgctcccgcctctcgagcgctgccggtggccgcagcggcgcacccacgccggcccggaggagcagagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccag

SEQ ID NO: 130315 - DNA, 563 bp, Homo sapiens
  Payload ID: 5498
  Gene Symbol: EPN2
  Gene Name: epsin 2
  ENST ID: ENST00000577195
  CDS Start-End: 377-563
atactgggaagaggtcagctgccccctgtgatttgttttctattcaaggaagcttttggtcccagtctcccatgttccaggtgtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagc

SEQ ID NO: 130316 - DNA, 546 bp, Homo sapiens
  Payload ID: 5498
  Gene Symbol: EPN2
  Gene Name: epsin 2
  ENST ID: ENST00000584633
  CDS Start-End: 320-546
gtgtgtacggggtggagtggcctgaaggggattagagtgcgcgcgttcggtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaa

SEQ ID NO: 130317 - DNA, 562 bp, Homo sapiens
  Payload ID: 5498
  Gene Symbol: EPN2
  Gene Name: epsin 2
  ENST ID: ENST00000582015
  CDS Start-End: 465-562
tccttccggccggccccctgctcgcatcttggcttgctgaggctgcgggtcttggccgggccttcgagaatcccccgccgcctccccttctggatgtatctgcgccgcctcctttctccctccccttccttccagcccttcattccctcggggcgggcgggcaggccggcaggccccgcgcaaacctggggaaagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtg

SEQ ID NO: 130318 - DNA, 578 bp, Homo sapiens
  Payload ID: 5498
  Gene Symbol: EPN2
  Gene Name: epsin 2
  ENST ID: ENST00000584150
  CDS Start-End: 518-578
atctgttctctcaagcttgctagccaagttcctccccacaccctaaattgtaatgactgcagcagatgtgagatggatgttccctcctctactccaggccagtttcccaaggcctctgggtaatgtctatgtgattaaacagtctcttgggaatagaactcctttcagttaagcagctctattttccagaaatccctggataattttatgaccatgtggtaaagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcag

SEQ ID NO: 130319 - DNA, 639 bp, Homo sapiens
  Payload ID: 5498
  Gene Symbol: EPN2
  Gene Name: epsin 2
  ENST ID: ENST00000581024
  CDS Start-End: 526-639
aaactgagccagacgcggcggtggcggcggctccgcgggctacggtcgctcccgcctctcgagcgctgccggtggccgcagcggcgcacccacgccggcccggaggagcagagggtctcactctatcgcccaggctggagtgcagtggcgcaatcttggctcactacaacctccacctctcgggctcaagcagttctcgtgcctcagcctcctgagtaagctgggattacagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttct

SEQ ID NO: 130320 - DNA, 637 bp, Homo sapiens
  Payload ID: 5498
  Gene Symbol: EPN2
  Gene Name: epsin 2
  ENST ID: ENST00000583197
  CDS Start-End: 572-637
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagagaaatgaggtctcaccatgttgtccaggctggtcttgaactcctgggctcaagtgatcctcctgccttggcctcccgaagtgctgggattataggcgtgagccactgcacctggccctattcctgtgacagctctcttggaagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatc

SEQ ID NO: 130321 - DNA, 591 bp, Homo sapiens
  Payload ID: 5498
  Gene Symbol: EPN2
  Gene Name: epsin 2
  ENST ID: ENST00000577692
  CDS Start-End: 307-591
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagaggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcag

SEQ ID NO: 130322 - DNA, 569 bp, Homo sapiens
  Payload ID: 5498
  Gene Symbol: EPN2
  Gene Name: epsin 2
  ENST ID: ENST00000580579
  CDS Start-End: 272-382
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccac

SEQ ID NO: 130323 - DNA, 4071 bp, Homo sapiens
  Payload ID: 5499
  Gene Symbol: EPN3
  Gene Name: epsin 3
  Uniprot ID: Q9H201
  ENST ID: ENST00000268933
  CDS Start-End: 580-2478
aaagcagaggggatcaggtcgccagcactggctccagatgtgcacttcctgggggcggccaacaggcaggccccccacctctcaatgcaccacttgcctggccagcaggaaggggttaacctgccctgcacttcctcctgtgtcctgttactgctgaggcagacctgccgggccagctgagcaactttcctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaatcgtatgaagaatttcaaaacagggacaacagagcatgaaaccaagcgcaaagcccactgcagtgcgattgcacaggtatctcaccttgcagccggcactactcccatttttcaggcaaggaaaccgtggctcagagaggttgaatggcatgctcaaagtcacaaagctggcatggggcggggctggaactcaagagtcagacagtctggctccaaggcctggagatcccaggctgggccccagatttaattcagcaaatattgactgactgctgtggacaaagtgctgggctcaccttggagggatccaacctccaggagctcgagcgcagcagggtagacaagccaggggcacgtgatgcggctgtggcagaagccaagtgcaggagctcccaggctcctttgttttactgagtcaccttaaatgtaactctgccctctcccttgcttcgccaaggctagcgagaaactcagtcttagccacacaggaggaatcggaccccttctgggggtttatgtggagtctgggaaaccaagggtggggtgaggcctggtactcaatccaggaggggcccctatgaccaccctcgcctgtttttcttctcaatgctccctgatcactggaccactggacactgatgtgtcctcagtgcttggggtctggctctgcaggcagcctgcagccagcctccatccccctttcagggacaaatggccttccaccagagtcggtgagtggagaggcacaatgccactccccttcctgaggtgggggtaggggaagggagtcccacaatgcagttacaaacaggatggacaagaacacctgctcaggagtcagacttacagggttcaaagttctgctccaaggtttgaccctaacaagaatcacttagtaataagtggttatgctctgtgaccttgagtaaattacttaccctctcca

SEQ ID NO: 130324 - DNA, 810 bp, Homo sapiens
  Payload ID: 5499
  Gene Symbol: EPN3
  Gene Name: epsin 3
  ENST ID: ENST00000507467
  CDS Start-End: 403-810
agcaagggggagggcaggagttaaacaagttgtggccgtggcattcccacagaaggcccacgacccgctggaaggaaagagatagcagacaaaagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggat

SEQ ID NO: 130325 - DNA, 2260 bp, Homo sapiens
  Payload ID: 5499
  Gene Symbol: EPN3
  Gene Name: epsin 3
  Uniprot ID: Q9H201
  ENST ID: ENST00000510045
  CDS Start-End: 365-991
ggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactgcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgtt

SEQ ID NO: 130326 - DNA, 1675 bp, Homo sapiens
  Payload ID: 5499
  Gene Symbol: EPN3
  Gene Name: epsin 3
  ENST ID: ENST00000512291
  CDS Start-End: 244-396
gtgctgcctggcgctggctaggaggcaaacgcacgcgggaagagctgctacccattccagggaccctgccgctgcccctctgaggggtctgcacctcctgggagcagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctg

SEQ ID NO: 130327 - DNA, 2449 bp, Homo sapiens
  Payload ID: 5499
  Gene Symbol: EPN3
  Gene Name: epsin 3
  ENST ID: ENST00000512379
  CDS Start-End: 385-537
gtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttc

SEQ ID NO: 130328 - DNA, 560 bp, Homo sapiens
  Payload ID: 5499
  Gene Symbol: EPN3
  Gene Name: epsin 3
  ENST ID: ENST00000515126
  CDS Start-End: 235-560
actagcaagggggagggcaggagttaaacaagttgtggccgtggcattcccacagaaggcccacgacccgctggaaggaaagagatagcagacaaaagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggactt

SEQ ID NO: 130329 - DNA, 580 bp, Homo sapiens
  Payload ID: 5499
  Gene Symbol: EPN3
  Gene Name: epsin 3
  ENST ID: ENST00000514874
  CDS Start-End: 428-580
aactttcctcggagtgctgcctggcgctggctaggaggcaaacgcacgcgggaagagctgctacccattccagggaccctgccgctgcccctctgaggggtctgcacctcctgggagcagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtg

SEQ ID NO: 130330 - DNA, 603 bp, Homo sapiens
  Payload ID: 5499
  Gene Symbol: EPN3
  Gene Name: epsin 3
  ENST ID: ENST00000503690
  CDS Start-End: 569-603
aactttcctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaa

SEQ ID NO: 130331 - DNA, 558 bp, Homo sapiens
  Payload ID: 5499
  Gene Symbol: EPN3
  Gene Name: epsin 3
  ENST ID: ENST00000507709
  CDS Start-End: 506-558
atttcccatcttgactctgccacccccagccacgggttggggaggtgaaggcaggtctgagtcactagcaagggggagggcaggagttaaacaagttgtggccgtggcattcccacagaaggcccacgacccgctggaaggaaagagatagcagacaaaagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggaggtaatgataatagcatctttggggtgtggctgtgaagatagatagatgagcatgcaaagctccaagtgcctgctgaattgtaagtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcat

SEQ ID NO: 130332 - DNA, 804 bp, Homo sapiens
  Payload ID: 5499
  Gene Symbol: EPN3
  Gene Name: epsin 3
  ENST ID: ENST00000503246
  CDS Start-End: 300-804
gtgtcctgttactgctgaggcagacctgccgggccagctgagcaactttcctcggagtgctgcctggcgctggctaggaggcaaacgcacgcgggaagagctgctacccattccagggaccctgccgctgcccctctgaggggtctgcacctcctgggagcagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttca

SEQ ID NO: 130333 - DNA, 2223 bp, Homo sapiens
  Payload ID: 5499
  Gene Symbol: EPN3
  Gene Name: epsin 3
  ENST ID: ENST00000537145
  CDS Start-End: 131-1087
gtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccaggccccgcccacttctgagccgcggctgcctctcccctccacagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagct

SEQ ID NO: 130334 - DNA, 2036 bp, Homo sapiens
  Payload ID: 5499
  Gene Symbol: EPN3
  Gene Name: epsin 3
  ENST ID: ENST00000574464
  CDS Start-End: 131-1087
gtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccaggccccgcccacttctgagccgcggctgcctctcccctccacagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggccc

SEQ ID NO: 130335 - DNA, 1186 bp, Homo sapiens
  Payload ID: 5500
  Gene Symbol: EBI3
  Gene Name: Epstein-Barr virus induced 3
  Uniprot ID: Q14213
  ENST ID: ENST00000221847
  CDS Start-End: 54-743
caagtctcccacgacgttcccacccactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatgggatctgcctagcctgggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaatta

SEQ ID NO: 130336 - DNA, 725 bp, Homo sapiens
  Payload ID: 5501
  Gene Symbol: EQTN
  Gene Name: equatorin, sperm acrosome associated
  Uniprot ID: Q9NQ60
  ENST ID: ENST00000380031
  CDS Start-End: 82-465
agacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagtatttaaattactacactgtattcatacctggagaatatcattatgtgacttaaaaatttaagtttcactactctgagcattacataaagccatagcatgcttaaagaatttatactgctaccttttaaagtcactaaaatcttttaaatggtgaatgtctaacagtcagtcttcaggtatacctgacaaaggatgagaaatgagcttttgtagaaatagaactttattttaataaaaatgtgttacatttgtgtctatattaaata

SEQ ID NO: 130337 - DNA, 1033 bp, Homo sapiens
  Payload ID: 5501
  Gene Symbol: EQTN
  Gene Name: equatorin, sperm acrosome associated
  Uniprot ID: Q9NQ60
  ENST ID: ENST00000380032
  CDS Start-End: 85-969
gttagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtcat

SEQ ID NO: 130338 - DNA, 879 bp, Homo sapiens
  Payload ID: 5501
  Gene Symbol: EQTN
  Gene Name: equatorin, sperm acrosome associated
  Uniprot ID: Q9NQ60
  ENST ID: ENST00000537675
  CDS Start-End: 82-879
agacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacggatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtga

SEQ ID NO: 130339 - DNA, 6146 bp, Homo sapiens
  Payload ID: 5502
  Gene Symbol: EDEM1
  Gene Name: ER degradation enhancer, mannosidase alpha-like 1
  Uniprot ID: Q92611
  ENST ID: ENST00000256497
  CDS Start-End: 134-2107
ggctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaattttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttgggtggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggttgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatactgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcagtgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttg

SEQ ID NO: 130340 - DNA, 978 bp, Homo sapiens
  Payload ID: 5502
  Gene Symbol: EDEM1
  Gene Name: ER degradation enhancer, mannosidase alpha-like 1
  ENST ID: ENST00000434243
  CDS Start-End: 52-288
cggagagcctgggggttggggacgatgggctagttcctgctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccc

SEQ ID NO: 130341 - DNA, 1363 bp, Homo sapiens
  Payload ID: 5502
  Gene Symbol: EDEM1
  Gene Name: ER degradation enhancer, mannosidase alpha-like 1
  Uniprot ID: Q92611
  ENST ID: ENST00000445686
  CDS Start-End: 187-1317
acgcgcttccttccgccctccgcgccggggtgcagccctctgtcctccggggcccccgagggcgccagggccgttagggtcccgggcagcgctcccgcgccctgtcccgtttcaaatctgaacatcaatgatgtactagggaactactcattgactcttgttgatgcattggatacacttgcaataatgggaaattcatccgagttccagaaagccgtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctggtatgtgtgttgcaagatgaacccaggaatatttagtattgcttagagcaagcattcgcatagtcttccatctgacaggtac

SEQ ID NO: 130342 - DNA, 730 bp, Homo sapiens
  Payload ID: 5502
  Gene Symbol: EDEM1
  Gene Name: ER degradation enhancer, mannosidase alpha-like 1
  ENST ID: ENST00000443790
  CDS Start-End: 20-181
gcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggaccctttgagagcatgatttctaccgaagcaaggggacatcccaagctaaattcaaaggactgagccttttcaaaattctaggaaaccgatgagtttttcttgcttaaccatagcgtttatacgtataagtgtattttctatctcaatttttttgagaaaaaatattaaattttgaaaaaaaa

SEQ ID NO: 130343 - DNA, 1756 bp, Homo sapiens
  Payload ID: 5503
  Gene Symbol: EDEM2
  Gene Name: ER degradation enhancer, mannosidase alpha-like 2
  Uniprot ID: Q9BV94
  ENST ID: ENST00000374491
  CDS Start-End: 62-1687
caggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcata

SEQ ID NO: 130344 - DNA, 1919 bp, Homo sapiens
  Payload ID: 5503
  Gene Symbol: EDEM2
  Gene Name: ER degradation enhancer, mannosidase alpha-like 2
  Uniprot ID: Q9BV94
  ENST ID: ENST00000374492
  CDS Start-End: 107-1843
gcaggcgcagtggcgcggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcatattttggt

SEQ ID NO: 130345 - DNA, 6898 bp, Homo sapiens
  Payload ID: 5504
  Gene Symbol: EDEM3
  Gene Name: ER degradation enhancer, mannosidase alpha-like 3
  Uniprot ID: Q9BZQ6
  ENST ID: ENST00000318130
  CDS Start-End: 268-3066
agtaacgttggggaggcggtttcctagactacgacaccggaaagctgggggaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgtggttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagttttaatttgaatttttagaatcactgtgcatatcctcatacttttatgtcttgatgtttatcactctgttttccttttttttttaaactcattttatcctccggggattgaattctggggacattttaggctgtagaaacccaagcttgtgggctaaagtaaggattttgttctaagaaatcactgaaagtttttcaacaagtcagtagcatgcacaaaggtaatgctaagtgaataaaactctagaattgtgtataaattatga

SEQ ID NO: 130346 - DNA, 6678 bp, Homo sapiens
  Payload ID: 5504
  Gene Symbol: EDEM3
  Gene Name: ER degradation enhancer, mannosidase alpha-like 3
  Uniprot ID: Q9BZQ6
  ENST ID: ENST00000367512
  CDS Start-End: 391-3108
gttggggaggcggtttcctagactacgacaccggaaagctgggggaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgtggttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagcagcaatattaaaaggtaaaatgattccaagctacattattaatagtaatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccagtttagtttt

SEQ ID NO: 130347 - DNA, 2872 bp, Homo sapiens
  Payload ID: 5504
  Gene Symbol: EDEM3
  Gene Name: ER degradation enhancer, mannosidase alpha-like 3
  ENST ID: ENST00000439962
  CDS Start-End: 1-1143
gtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtgaagccagtgtactttctcagtgagttctctgcataaagactaatcagtgggaccaggtaaaaaggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattcca

SEQ ID NO: 130348 - DNA, 962 bp, Homo sapiens
  Payload ID: 5505
  Gene Symbol: ERLIN1
  Gene Name: ER lipid raft associated 1
  ENST ID: ENST00000370408
  CDS Start-End: 138-962
gttggcggcggttggctcggcgcgggagtcggctgcacgtgcgggcgggggcgatgcgtcactgatcggtgaggcgcggccgaggggtcggctttcctcgcgagcctgcggctgggcttcttctcagaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaag

SEQ ID NO: 130349 - DNA, 1453 bp, Homo sapiens
  Payload ID: 5505
  Gene Symbol: ERLIN1
  Gene Name: ER lipid raft associated 1
  Uniprot ID: O75477
  ENST ID: ENST00000407654
  CDS Start-End: 84-1130
ggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaa

SEQ ID NO: 130350 - DNA, 5792 bp, Homo sapiens
  Payload ID: 5505
  Gene Symbol: ERLIN1
  Gene Name: ER lipid raft associated 1
  Uniprot ID: O75477
  ENST ID: ENST00000421367
  CDS Start-End: 2709-3755
attataataaaacagttgaatatggcttaggaaaatatgaaggttccatgaagtggaattaagagcatagaataactgtactttccttaggaataataggacttatggtaaaggtagtattgggcaacttctttaagagtgttttcctctgagatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtagtgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaagggcgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggggtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatca

SEQ ID NO: 130351 - DNA, 6073 bp, Homo sapiens
  Payload ID: 5506
  Gene Symbol: ERLIN2
  Gene Name: ER lipid raft associated 2
  Uniprot ID: O94905
  ENST ID: ENST00000276461
  CDS Start-End: 68-1087
ttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtgggatccttgttatctcttagccactgcaggacctgcctgacaggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaagggttttctttttcattactaggtcagaacattttgagtcaccttgggagattcaggatggggagagcaaatttgaacaaaaggtttttcttatatcctgagattgaggggtagggggtgtccaacctgtatagcccatgggttgtgtctagaattaagtggagggcagctatctggagttaacttgcaagcatattggtgccctccatgaccacctctggcttaggacttggccctgttatgagctgacccccaccccccaccccccaccccccccccccgccaactcctatacccatcttccctaggtgaatctgtgaatggtcctttctggcagcaatccctgccttctttttgggcccatgcccagacttctggtttaaggaatggtcccagagcttgggccagcttgctcagaagttttgggagcattgagcctgcctagaaagatacagtgttagctccccttacttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtgaacgtggcataattcttggtaggtgctatagagatttatcattttaaacagttcacacaccactgcaattctgctccaaaggacaaagatattttcaagtgaaccaaaattcattttgatatcagttcagtggacgaactcccagtctttactctggaaagctgcccagcttagggttgccagataaaacataagatacctagttaaatatgaatttcaacaatgtacaatttttagtctaagtactatgtgtcctaaacactgcatgagacatactcataccaaagtatttgttgcttatgtgtaattcatatttaactgggtatcctgtatttttacttgttaagtccggcaaccctagcccaggctttctcaggttttttttaacagggatcccaagctttttctattggtttgagagcctgctacacaaataatatgatcttaacaattgaatagttatgttaagagtgtagttactgcagttagactgccaaagttcaaatcactgctctactacttcttaggtgtgtggtcttgaataagttttttgacctctctaagcctcagtttcttcattaataaaatgagttgcatggcttatatgaaataatgcatacgaagggctttcacactgtaccttgcatgtatgtattcaaaaacttcaatctggagaaacgggctaaaaaacatacagctattaaatgggagccactaagtagaaagccaaacacgtgaaaaaaaatggaataagattacaaatgggatagcacatagaagaagggaatgacattgcaatgcagcaaacacagtattgaggatacatacctctacaaaaatgttgtgtagaaaataacctggtttaaagaaagaaaagaaaagaaaagaagccaggcacggtggttcacacctgtaatcctagcactttgggaggctgaggtgggtggatcacctgaggtcgggagttcaagaccagcctgaccaacatagagaaaccccatctcgactaaaaatagaaaattaaccgggcatggtggtgcatgcctgaaatcccagctacttgggaggctaaggcaggagaatcacttgaacctgggaggtagaggatgcagtgagccaaaatcacgccactgcactccagcctgggcaacaagagcaaaactctatctccaaaaaaaagaaaagaatctgatttggccctgttgagaggaactgtccagttctggtctccaattttaaaaatgaaaaaaatttgaagaagctagaaagaaaatgttaaaaccaaaaag

SEQ ID NO: 130352 - DNA, 1742 bp, Homo sapiens
  Payload ID: 5506
  Gene Symbol: ERLIN2
  Gene Name: ER lipid raft associated 2
  Uniprot ID: O94905
  ENST ID: ENST00000335171
  CDS Start-End: 339-797
ggcccccgccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaaca

SEQ ID NO: 130353 - DNA, 1473 bp, Homo sapiens
  Payload ID: 5506
  Gene Symbol: ERLIN2
  Gene Name: ER lipid raft associated 2
  Uniprot ID: O94905
  ENST ID: ENST00000397228
  CDS Start-End: 96-554
ggaagtcgcgtgctgaggggtgtgacggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagc

SEQ ID NO: 130354 - DNA, 2623 bp, Homo sapiens
  Payload ID: 5506
  Gene Symbol: ERLIN2
  Gene Name: ER lipid raft associated 2
  Uniprot ID: O94905
  ENST ID: ENST00000518586
  CDS Start-End: 343-963
acgcggcccccgccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacagatca

SEQ ID NO: 130355 - DNA, 1718 bp, Homo sapiens
  Payload ID: 5506
  Gene Symbol: ERLIN2
  Gene Name: ER lipid raft associated 2
  Uniprot ID: O94905
  ENST ID: ENST00000519638
  CDS Start-End: 358-1377
tactggtaggaaaggttcagtgacagcacattcgtgttcacaggaagacaaggctgtgttctgaaccctacccagctggcacgggttctcccttgagcaacggctgtatccggagccagtgcttcctcagtgcggtgggggctctaattttacagttaaagaaaggggaacgttgactgagaacgaggaggaagcgagttgtagatctagccttgtgttcacacgacaccaggctggatatgagtcactcgcagggagctcagcttggtgaggtcctctcgctgttgtggccttttctcctgcacgttggaccacacacattttcccgtgtcttttccctaggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaa

SEQ ID NO: 130356 - DNA, 663 bp, Homo sapiens
  Payload ID: 5506
  Gene Symbol: ERLIN2
  Gene Name: ER lipid raft associated 2
  ENST ID: ENST00000518526
  CDS Start-End: 72-663
acggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaaga

SEQ ID NO: 130357 - DNA, 1602 bp, Homo sapiens
  Payload ID: 5506
  Gene Symbol: ERLIN2
  Gene Name: ER lipid raft associated 2
  ENST ID: ENST00000521644
  CDS Start-End: 587-1602
gccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggtaaaataagcgcctcgcagatgtccgcgccccggttacgttagacctgggaggcagaatccacgccctgcgctcacgggcccacgcacgcacagctgaactttgcagtcagtcaccatagttccagatcattcagcgttcaggatcccactcctccgcgtcctggtgcctgaacgcggttggacctaggagcctagaggctcgcagtttgggacattgcctttctctctgaccacgggcttggggatctgtcaggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaa

SEQ ID NO: 130358 - DNA, 2347 bp, Homo sapiens
  Payload ID: 5506
  Gene Symbol: ERLIN2
  Gene Name: ER lipid raft associated 2
  Uniprot ID: O94905
  ENST ID: ENST00000523887
  CDS Start-End: 70-690
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacaga

SEQ ID NO: 130359 - DNA, 771 bp, Homo sapiens
  Payload ID: 5506
  Gene Symbol: ERLIN2
  Gene Name: ER lipid raft associated 2
  Uniprot ID: O94905
  ENST ID: ENST00000523107
  CDS Start-End: 123-743
gtaaaataagcgcctcgcagatgtccgcgccccggttacgttagacctgggaggcagaatccacgccctgcgctcacgggcccacgcacgcacagctgaactttgcagataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggacca

SEQ ID NO: 130360 - DNA, 355 bp, Homo sapiens
  Payload ID: 5507
  Gene Symbol: EMC1
  Gene Name: ER membrane protein complex subunit 1
  ENST ID: ENST00000356068
  CDS Start-End: 19-246
ggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctgtgagtgaactgagaactgtgtctactggctgcctcagggatgaaagacttaccattgccaactctgcctggctgattcctgaataaggaacatgttggccaaaagatgcctctcct

SEQ ID NO: 130361 - DNA, 5408 bp, Homo sapiens
  Payload ID: 5507
  Gene Symbol: EMC1
  Gene Name: ER membrane protein complex subunit 1
  Uniprot ID: Q8N766
  ENST ID: ENST00000375199
  CDS Start-End: 1-2979
atggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagacagaatctcactctgttgcccaggctggagtgcagtggcacgatcttggctcacggcaacctccacctcacaagcagctgggactataggcatgtgccaccacgctcagctaattttttgtatttttagtagagacggggtttcattgtgttggccaggctggtctcgaactcctggcctcaagtgatctgctggccttggcctcccaaagtgctgggattacaggtgtgagccaccgagcttggccaagtgcttaaaatagttaatgctaatgccacagtccaatttaaatcttttcttagttctcaactttccttaatcttaaagcagcattcggttctgagcagctacactcagtctccactaatggctgctgagactatgtttcctctctcaattctctgatctatttgctttcttgtcattccttgttttttgtgtgtattccttgacttacctcttctcctgtcttcattaattaggttaattttggggccccatggtgtttcacgtaaaaagatttggctgggcgtgatggctcatgcctataatcccagcactttgggaggccatagtggaggatctcttgagcccaggagttccagaccagcctgggcaacatagcaagactctatctac

SEQ ID NO: 130362 - DNA, 4084 bp, Homo sapiens
  Payload ID: 5507
  Gene Symbol: EMC1
  Gene Name: ER membrane protein complex subunit 1
  Uniprot ID: Q8N766
  ENST ID: ENST00000375208
  CDS Start-End: 14-2929
atgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatct

SEQ ID NO: 130363 - DNA, 425 bp, Homo sapiens
  Payload ID: 5507
  Gene Symbol: EMC1
  Gene Name: ER membrane protein complex subunit 1
  ENST ID: ENST00000486238
  CDS Start-End: 1-260
acaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgt

SEQ ID NO: 130364 - DNA, 557 bp, Homo sapiens
  Payload ID: 5507
  Gene Symbol: EMC1
  Gene Name: ER membrane protein complex subunit 1
  ENST ID: ENST00000475079
  CDS Start-End: 17-244
tgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctgtgagtgaactgagaactgtgtctactggctgcctcagggatgaaagacttaccattgccaactctgcctggctgattcctgaataaggaacatgttggccaaaagatgcctctcctagtggattctgatactttttttttttcagtcttaccatctttgaatattttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacag

SEQ ID NO: 130365 - DNA, 583 bp, Homo sapiens
  Payload ID: 5507
  Gene Symbol: EMC1
  Gene Name: ER membrane protein complex subunit 1
  ENST ID: ENST00000486405
  CDS Start-End: 1-537
tttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgagctttgctggatccccgccgccccgagatcccaacagaacaaagcagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcct

SEQ ID NO: 130366 - DNA, 6664 bp, Homo sapiens
  Payload ID: 5507
  Gene Symbol: EMC1
  Gene Name: ER membrane protein complex subunit 1
  Uniprot ID: Q8N766
  ENST ID: ENST00000477853
  CDS Start-End: 44-3025
ggtgcatgccgggacggcggtgggtggtgcatgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatcttgtggcgccatgttgacaagggcacggcagaaggggctgtggatgccatgctgctgcacggacaggatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacagactgccctagtgagctttgccaccactggggagaagacggtggctgcagtcatggcctgtcggaatgaagtgcagaaaagtagcagttctgaagatgggtcaatggggagcttttcggagaagtctagttcaaaggactctctggcttgcttcaatcagacctacaccattaacctatacctcgtggagacaggtcggcggctgctggacaccacgataacatttagcctggaacagagcggcactcggcctgagcggctgtatatccaggtgttcttgaagaaggatgactcagtgggctaccgggctttggtgcagacagaggatcatctgctacttttcctgcagcagttggcagggaaggtggtgctgtggagccgtgaggagtccctggcagaagtggtgtgcctagagatggtggacctccccctgactggggcacaggccgagctggaaggagaatttggcaaaaaggcagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtcacagcttttccagccactcggaatgtcttgcgacagctacatgagcttgccccttccatcttcttctatttggtggatgcagagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtgtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgattggactaccttctggagcaattctttcccttcctaaggctttgctggatccccgccgccccgagatcccaacagaacaaagcagagaggagaacttaatcccgtattctccagatgtacagatacacgcagagcgattcatcaactataaccagacagtttctcgaatgcgaggtatctacacagctccctcgggtctggagtccacttgtttggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatgacactgtttaagtcctcttttgtgtcttagaagatcattttgaggctattttcacattagaggggataaaagcagtgaagacatggagtaagtgtattttattttagtaaggaaaggtcagtttaatcatatatgggttggttaggttatctaaaaatttgtcatctttctatggtcatatgctgatggtagattatggcagagaaggaagaggaaatgacaaccattttattaattgtcagtttgatattgagtgactgaatgtctaagaatctccagaaaaaaacaggcatctatcatcctgacccaaggcatattttaacataacctgggagaagagagttaagtacaagttaaaaaaaattctgccctagttttgagaaagcctggctggaattctgactgtcttacatacatatgtgcaaggttagcctgcaagattctagtttttatttaccagtgtgccagaatctgaaacaagctactgggagggaaggtatttgtcctttagtaaaattccctgtatttcagctgtaatcaaagttacctcaaagcaggtgctttttttttttttgagacagaatctcactctgttgcccaggctggagtgcagtggcacgatcttggctcacggcaacctccacctcacaagcagctgggactataggcatgtgccaccacgctcagctaattttttgtatttttagtagagacggggtttcattgtgttggccaggctggtctcgaactcctggcctcaagtgatctgctggccttggcctcccaaagtgctgggattacaggtgtgagccaccgagcttggccaagtgcttaaaatagttaatgctaatgccacagtccaatttaaatcttttcttagttctcaactttccttaatcttaaagcagcattcggttctgagcagctacactcagtctccactaatggctgctgagactatgtttcctctctcaattctctgatctatttgctttcttgtcattccttgttttttgtgtgtattccttgacttacctcttctcctgtcttcattaattaggttaattttggggccccatggtgtttcacgtaaaaagatttggctgggcgtgatggctcatgcctataatcccagcactttgggaggccatagtggaggatctcttgagcccaggagttccagaccagcctgggcaacatagcaagactctatctacaaaaaataaaaaaaaattagccgggcctggtggcatgtgcctgtggtcctagctactcaggaggctgaggtaggaggatcacttgagcctgggaggtcgaggctgcagtgagccatgaacatgctactgcattccagcctgggcaacagagtgagaccctggctcaaaaacaaaaacaaaaactagtttgttttagtattcattaattacgtatatgagcactggtagtctagtgtttgttcttgtatacagtgttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgtattcataaagatgactgaaatagtttctggaacaaagtctgatagaaaaaatactcaattcctaatttaagtgttagagactttaatgtaagctatctaatctgaactagtttcattatttgtgtgtgggtacatgttatgtgctccgtaaggcatctttcaatttgaaaatttcataattgtaatttcactgcctttataaattgctttttttttggaggcagggtctctgtcacccaggctggagagcagtggcacagtcatagctcactgcagcctcgaacacctgggctgaagtgatcctccctccttagcctcccaaagtgccgggattacaggcatgagctactgcacctggcccataaattgtcatacttttaaagagcctattacacaaagtatcatcagaatcatcccaagactcatttcctgattcctaattatttaaaattttgcttttaggcgaggcatggtggctcaagcctataatcccagcactttgggaggccaaggcaggcagatcatttgaggtcaggagtttaagaccagcctggccaacatggtgaaacctgaaaccccatctctaccaaaaaaataaaaaaatttagccaggtgtggtggtgcatgcctgtaatcccagctacttgggaggctgaggcaggagaatcgaacccaggaggcaaaggctgcagtaagccgagatcatgcctctgcactccagtctgggcaacacagtgagaccctgtctcaaaaataaataaaatgaaaaaattgcttttaaatcat

SEQ ID NO: 130367 - DNA, 9446 bp, Homo sapiens
  Payload ID: 5508
  Gene Symbol: EMC10
  Gene Name: ER membrane protein complex subunit 10
  Uniprot ID: Q5UCC4
  ENST ID: ENST00000334976
  CDS Start-End: 47-835
ggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgcagctagcctcctgcattgtatggttataaatagcaccctagtgagtgctgtcgtccagtctctcttgggtgtggtttgaatgatctcgggatgcatgactaaaatggaattacgatggcagatcggaaacgcgtttataaacaagtgatggtttgtgagtcgactgtcaagaccaggaggtggtgcaccgtgggaggttgccttccctcccatcacttctttttgtttttgagtcagggtcttgctctgttacccaagctggagtgcagtggcggtaccttgactcactgcgacctccacctctcaggctcagcgattctcccacctcagcctcctgagtagctggaattgtaggcgtgcaccaccacgcgcagctagtttttgtattttttgtagagacggggtttcaccatattgcccaggctggtcgtgaactgctggactcgagtgatccacctgcctcggcttcccaaagtgctgggattacaggcgtgagccaccgcgcctggcctatttttggtaactttaataaagaagatagtcttagcattgctaacttctgtttctttctccacctgcaggagatagcttatgctttttctgtcttcattccatgtgaatcctgcttcattcttttcctagaggattccagaaatatttactaatgctttttttttttttttttttttttttttgaggcagagtctcgctctgtcatccaggctggagtacaatggcacgatctcagctcactgcaacctccgcttcctgagtttaagcgattctcctgcatcagcctcccaaatagcggggattgcaggcgcccgccaacacacctggctaatttttgtattgttagtagagacagggtttcaccatgttggccaggctagtcttgaactcctgacctcaggtgatctacctgcctcagcttcccaaagtgctgggattacaggcatgagccactgcgccaggcctactgatgctttttgggaagtgttcccaacttggagtcctggtccctgtgtctgatctgcagatgtcttctaccccggcactgggggaacatcttatttttcctgggttaaacattgggatctttataaacctgattatgtcctttccctctaagtctcggttgctttcaggctggcagggttactctgttgggtattccaggaaatgcctgagctccttcaggctcccctagcgttctgttcttattaaacttttcttccccgtctggccggtccttggggaacccactcactattttattttattgaccgggttatccagggatgaagtatgaaactcaaaagatagagtaggttggccaggcatagtgattcatgcttgtagtcccagctgtttgggaggctgagacaggaggatcgcttgagccccagagttcgatgcttcctgagctgtgattgaatcactttactccagcctgggtgacagagtgagaccctgtctccagaatagacaaaagatgcagtggaatccacgtccagaaactgtatgctcactctgggctccagcacccacttcccctccctggaggcagcctgagttttctgtcccctggtatgctgcagatactctccacagaaacaagcagatgcacatgtcaacagttttgcaagtgttgctcttttcccccaccttcttttgacatagctggggcagtttccatctctggtataaggtgccatcttattccatctctggtgtaagagtgtgttgctggatttgagtagttctaagcagcactgcaggagtccccctgttctgctgcatcattttgcacacatatgtgtctgtggaagacatggcccggtggggccccaccttgctgggggagagggatgtgtgtgtgatggtggtgcatgcttcccccttgctactccaggtgtctgccccatcccttcaccctggaggttccagacagcccctcttcaccagcgattccccaactcatctccagctcagatcccacccctgatctccagactcatggccccagctgcctcctgggctccttccccaggatgtgcctcaggggccactaaaggagccagtgcctcccacctgcccggatcgggtgctcctccagggatctttgttccagtgagtggtgccatcacctgcccaacctcatggaccagagcactgccctgtcccaatcacgttctcctatgcaccaccatacctacccctaaagttcttcctggcctcatcccgtcacctctgtctccatggccttggtcccagctcaagcctcgtcctctgccacctggaccatcggcccagcctcctctttggcctcccagcccccaacatccccccctcagtccatccccctaatggagagcttcctgacactagagctgacctcactactcccctgctcacagccctccgcgtggcctctcacctcccccaggatagagtcccaacccatccttctgtgtctcctcctctctgtgtccactgtcctgaccctaactcaatcctcattctctgcctcctggaccctcatcctagcctcgtgacttctggtctaagatgtgagagcacctggcaaggtaaatgctccaggaggggttgctccctcccatttcctgccaccagaaaatgttatcggctgcgtggcattgcgaaagccttcctcttcccagcctagggtttcatgtgggcatttaggtgctcccagtacatagttgcatggcaaacaatcctaaaatatacaagactacatttagtattttgtaaaattctttactaaccccaaattgtctactggaaactataggctcctttttttttggtgggtggggggcaggtgtgtttgtgggatggagtttcacttgtcacccaggctggagtgcagtggctcaattttggctcaatgcaacctccacctcccaggttcaagcaattctcttgcctcagcctcctgagtagctgggattacaaccgtgtgccaccacacccagccaatttttgtatttttagtagagaccgggtttcaccatgttggccaggctggtcttgaactcctgacctcaagcgatccaccttagtctcctaaagtgctgggattacatgtgtgagccaccgcccctggcctctgtaggcttctttaacccatcagagagactccctggtaaggattaggggctaattactggtgcctcttcagctgtcagtccatcctcctttatttgtacccaccttccagtcagcaaggcacaacaatgttgttacaaaggaaacaaactcaatttggcccatttcctggaaatgcaatctcccaaacaggtttgtgtgaaccaaattccattttcctttgtttcccatgtgcagtcccagttgcatttccatgggagccaatccacccacccatagaatgacttgaaaatgtgtgaagttcagaagtttcataccaagaagtttgctgagcatgatgtttgtatattgattaggagtaaaaatgttcatttttacaaaatattacaacttctccctctcccctccttccacccagtatcccctgttcctcccccaggcattctggtcactgttcctttttgttgagatcattctcggtgtctcatatagctgggttgcagctccgttctttgccaggaggtggtaatagaggattccacgcactcagaatgcctcaggccggcgcctgtggcttctctcaatggagggaagtgtcctgcagggggcgctgttggtccttcaggcaaggtcgggttccctcgaagtctctgtcttagcagttgctggtcttcagaaacattgggcaccaattttctcatttctgaaatggaattcaggtgaggtcccctcagtgctgaggtgcttcatgttgtcagaggaagagttgggaagggagcggaatggagcagaaaggcgtcatccgctgctcactgagctcagataggaggccagggatcggcagattcaggagcccactcctggccaaccccaggggccccacccagtcctgtccctgctccttacgtgctgtgtatctttaggcaagttgcttcctgtctctgagcgtcgtctttgtttccgccttcctgggcctacggcaggcctgattcctccaggcagtgtccagagttccggacagatggaaaaggaagagagaatgggtgtcacaaaggtctgtccactcctgggcctcaggcttgggggccctgctcagggctagcctgtttgggcctcggtatggactcctgcctcctggtcaggacctggaaacctgggagcaggcaaggcaggaacaggagagggaggcaaaggcccaccaggcagggatgcaggggccacctggagacggaggagacggggctcccgggagggaggccagtgggagtgagagcttgaaggagagagagccaggagaggagacaggtccagagaggagggaaaggaaaggacagggcagagacagagaaaccagagagagggaaggaagagagacccaagggggagagacagggaaggaagagggaggtgagaagaggaagaggcagattcagaggagagaggagagaaaagaggtggaaatcaaacaggagaaagagggaggagaggagggaggagagagtgtaggaaaaaagcaggaggaaagagccgggcacggtggctcacgcctgtaatcccagcactttgggaggccaaggcaggcagatcacgaggtgaggagatcgagaccgtcctggctaacacggtgaaaccctgtctctactaaaaatacaaaaaaaaaattagcagggcatggtggcaggcgcctgtagtcccagctactcgggaggctgaggcaggagaatggcgtgaaccctggaggcggagcttgcagtgagccgagattgcgccactgcactccagcctgggcgacagagcgagactccgtctcaaaaaaaaaaaaaaaaaaaaaaagaaaagatggccagagcaggaggggagagaggaagagggagaaagaaggaaacagtgtagggggtcagaagtggaaagagaagaaaaaacagaagaggaaagaaagacgagggggtgaaaaaagggacaggaaggaagagagggagagggtgggtgccatggctggtgagctcggagaagagggaagcagagaaacgggtgaaggagggagcgtcctagggagaagtgggtgggggagagggtgttgggggagaagagggtgggggagagggggccccgggagagggagggatggaggagcggggagctccagccagagaagaggaaagagaaaggagagagctaggaactgggaaggaaaagagctaggaggagaccatgagacagaaagagaagagggtgaagagagaggatagtggctgggaggagagaggaggagggaggagcacagagggagaggagaggaaacagccagagaatctgctagaagggagagaggagagagaagagccggacagggagagcagaagtgagaaaaaggagggtggccacagagaggacagcgagaaaaagagaacaggaagaggggaaaagagaagaaatgggagagggaagaagggtgggagagaaaacggaacagagagggggcacagacagcggactggaccgagagggagatggagcggtgcggagggggagagagaaagagggagggaaggagggtaggagagggctggagataggggaaaagagaaaaggagggtaggagagggctggagagagaagggaagttaagaagggaaggagagagacagacattagggaagaaggaaaggagaaaggaaaaaatacaaaaaagggcagagagaaaagaacaggccgggcatggtgcctcgcacctgtggtcccagcactttgagaggctaaggcaggaggatcactggagcctgggaggtggaggctgcactactgcactccagcgggtgagtgagcgagaaaaaaagcagaaaggaaagaagaggtgcatgagtgtggaagagcaatatggagagaaagaagggagagaggattggaagtagcgacagaggaccatgcccctccagctgaggagggggcgcccctaagacagcgtcagcccagagaccggggcaggaagcaggaacgtgaagcaggttaggagccagtgtgaggcacggagagggccgggtagctgggcggcgggggtgtcgtgggcacagcccaggctactgcggggacaggctgccagacccggcgggtccaggttgggaactcggccatgcagcagaaacgttccctgcctcaacagggcgcagccaccccggggccatctctgtgacccagggagagaaaggacaacgaatgggactagacgaggatggggaggaacagagcagctgtggaaggtgcggcagagaagggcccaggagaaaggaggaagggaaggagctggaggggcgggagaacaggagacagaacaggacagagacagctgcccgggaggatgggagaacagaaagagggaggaaacgccgagcactgacctgggggaggggagtaaagagaagtgaagggggattggaagggaactggagaatgagagaagcaacaggcggggtgcgtgtaggagggcgggagagccaatgacaagacagaaaaggcagagaaagcaaagcaagaccagactcctcatccggtaacactgtgtcaggtcattgccctcccaccccgcccccaaccccataactgaaaacaagtaggaacctggataaaatagtcttaacaattttttttttgagacggagtcttgctgtgttgcccaagctagagtgcagtggcgcgatctcggctcactgcaaactccgcctcccgggtttaagcgattctcctgcctcagcctcccaagtagctgggattacaggggcccgccatcgtgcctgctaatttttgtattttttagtagagacggggtttcaccattttggctaggctggtctcgaattcctgacctcatgatccgcccaccttggcctcccaaagtgctgggattacaggcgttgagccaccgtggccggcccttaaaagcatcaaactacatacaagaccgtaaggaagctgtgggtcaacgcggagggacgtgggaacccatcccggtgaagcggcagcgtcacgtcctttctcccagggatctgttggtcggagacatctggactttcatgtggacagcctgagtgacagggggacccaggggcctcacctgggctacctggggtgggtggaccctccactgtgccaaggtgcagcctgggctcggaggaacatgccctccgcctagtccctgacatccttttcacatccaacacgcagagcaggggcgtgagggagcaggcaagcagggaagggaaagacaatgagcaagagccagcgggacggtggggcggatggcagaggcttcgctgctggaaaatcagacgcagagtacgaaacgcctgtgctcactatgttaataataataataaaaggcaaaaaaccag

SEQ ID NO: 130368 - DNA, 2014 bp, Homo sapiens
  Payload ID: 5508
  Gene Symbol: EMC10
  Gene Name: ER membrane protein complex subunit 10
  Uniprot ID: Q5UCC4
  ENST ID: ENST00000376918
  CDS Start-End: 47-811
ggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggcacatcatcctggggggggccgtgttgctcacagccctgcgtcctgctgcgccagggcccgcgccaccgccacaggaggcctgatggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 130369 - DNA, 2178 bp, Homo sapiens
  Payload ID: 5508
  Gene Symbol: EMC10
  Gene Name: ER membrane protein complex subunit 10
  ENST ID: ENST00000601780
  CDS Start-End: 146-274
caggccccaggtgcggacgggtgccagtgcgcaggtgccggggcccagcgcaggcgcacgggcgtcaggatgcggcctgttcctcccggcgtgctccgcggctcttggctcacagccgtcccttcgctggtgggaagaagccgagatggcggcagccagcgctggggcaacccggctgctcctgctcttgctgatggcggtagcagcgcccagtcgagcccggggcagcggctgccgggccgggactggtgcgcgaggggtgagtgctctttagctgtgcatagcgggcgcggtctacggatgtcgcaggtcttgggtctttaggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggcacatcatcctggggggggccgtgttgctcacagccctgcgtcctgctgcgccagggcccgcgccaccgccacaggaggcctgatggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcagtttattaaactgtcccccagatcgacacgca

SEQ ID NO: 130370 - DNA, 180 bp, Homo sapiens
  Payload ID: 5508
  Gene Symbol: EMC10
  Gene Name: ER membrane protein complex subunit 10
  ENST ID: ENST00000597426
  CDS Start-End: 50-180
cgcggctcttggctcacagccgtcccttcgctggtgggaagaagccgagatggcggcagccagcgctggggcaacccggctgctcctgctcttgctgatggcgcactcatttgagatcgatgacagtgccaacttccggaagcggggctcactgctctggaaccagcaggatggtacctt

SEQ ID NO: 130371 - DNA, 462 bp, Homo sapiens
  Payload ID: 5508
  Gene Symbol: EMC10
  Gene Name: ER membrane protein complex subunit 10
  ENST ID: ENST00000597799
  CDS Start-End: 197-462
gtccgggcggttgaaatgaaagaggcaaggtgaagccgggcgcggtggctcatctgtcatcccaacgcttagggaggccgaggcgggaggattgctctaggccaggagttcaagaccagcctgggcaacatagcgagccctgtctctacaaaaaatactaaaaaaaaaaaaaaaattaggccggtcgcggtggctcatgcttgtaatcccagcacttcgggaagccgaggcgggcggaccacttgaagtcaggagttcaagaccagcctgctcaaaatggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgg

SEQ ID NO: 130372 - DNA, 1610 bp, Homo sapiens
  Payload ID: 5508
  Gene Symbol: EMC10
  Gene Name: ER membrane protein complex subunit 10
  ENST ID: ENST00000598585
  CDS Start-End: 25-1140
cttcgctggtgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccgccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaaga

SEQ ID NO: 130373 - DNA, 1926 bp, Homo sapiens
  Payload ID: 5508
  Gene Symbol: EMC10
  Gene Name: ER membrane protein complex subunit 10
  ENST ID: ENST00000599293
  CDS Start-End: 12-140
aagaagccgagatggcggcagccagcgctggggcaacccggctgctcctgctcttgctgatggcggtagcagcgcccagtcgagcccggggcagcggctgccgggccgggactggtgcgcgaggggtgagtgctctttagctgtgcatagcgggcgcggtctacggatgtcgcaggtcttgggtctttaggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaatactggatgtacatcattcccgtcgtcctgttcctcatgatgtcaggagcgccagacaccgggggccagggtgggggtgggggtgggggtggtggtgggggtagtggccggtgagggcccaggctggtcagcgtcccgtcttgcacacccaggggcctccctttctgctggagtcccctgtgtcctcagccatcccaagaagggtttgctggtccctcctttccccccgtcccacgaggccacctgggccagccccttgtcctctgccttctgctggcagaggagcagctggactggggcctttggcacagcagccggtgtctcctgcgcccgcctcccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccgggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcag

SEQ ID NO: 130374 - DNA, 1243 bp, Homo sapiens
  Payload ID: 5509
  Gene Symbol: EMC2
  Gene Name: ER membrane protein complex subunit 2
  Uniprot ID: Q15006
  ENST ID: ENST00000220853
  CDS Start-End: 36-929
gccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaa

SEQ ID NO: 130375 - DNA, 404 bp, Homo sapiens
  Payload ID: 5509
  Gene Symbol: EMC2
  Gene Name: ER membrane protein complex subunit 2
  ENST ID: ENST00000519642
  CDS Start-End: 1-404
ggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgatttgcaggtcgaagtaagaaggaaaccaaatattctcttaaggctgtcgaag

SEQ ID NO: 130376 - DNA, 533 bp, Homo sapiens
  Payload ID: 5509
  Gene Symbol: EMC2
  Gene Name: ER membrane protein complex subunit 2
  ENST ID: ENST00000524143
  CDS Start-End: 196-533
gggtcacgtgactgcgtctccccgccctctcaccccgctgcctctaggttctgggaagatggcgaaggtctcagagctttacgatgtcacttgggaagtgcccagatcaggcctggcacataggcatttaggaaatattagttgagtgatgaagaactccaatatttactccaagaagtaaatattagtggaataatgaagtatagttccagtcatacactatactgcctcaaagaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgatag

SEQ ID NO: 130377 - DNA, 2777 bp, Homo sapiens
  Payload ID: 5510
  Gene Symbol: EMC3
  Gene Name: ER membrane protein complex subunit 3
  Uniprot ID: Q9P0I2
  ENST ID: ENST00000245046
  CDS Start-End: 460-1245
tgcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccatctgaaaaaaaaaaaaaaatatatatatatatatatatatatctatcttagcagaagcccagtcttcgaaggaagcattgttaattatagctaatgattatgtgcagtcagcctgacatctagccacagtaaactcctgttttcttgggatccaaacaccctgtgttttaccattagttttgttagtattgttaactttctttacacaagtaaaccatttccactaccaaaggtttagaaactatggatgaacaaaatgaatctccctgttcattttgagcctacatagacatagagaccaaatatgtcaaaaccttattcaaataaactctcttcagagtgaatacccagggtcaggacagactcagcaaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaaccgtcctgttttctcttctttgcctgtgaaagtgttgcctctgtaagtcactaacaaccttctgccagcagttgactgtctatcttggatcagtgcggggagtctaagacgaaagagatgtgaaccttgccctcaactcacaagagagagacacctaagagct

SEQ ID NO: 130378 - DNA, 751 bp, Homo sapiens
  Payload ID: 5510
  Gene Symbol: EMC3
  Gene Name: ER membrane protein complex subunit 3
  ENST ID: ENST00000429759
  CDS Start-End: 22-633
gggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagaaaatatctttcaggcctggtgcaatggctcacacctataatcccagcactttggggggctgagatgggaggatcccttgagcccaggaatttgagaccaaccttggcagcatgtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctggtaagaactttcttttgtttaataaaaacacaaaccacactttgggaagccaaggcgggaggatcacttgagcccatgagtttgagaccagcctgggcaacagagtaagaccctgtctcaag

SEQ ID NO: 130379 - DNA, 570 bp, Homo sapiens
  Payload ID: 5510
  Gene Symbol: EMC3
  Gene Name: ER membrane protein complex subunit 3
  ENST ID: ENST00000470827
  CDS Start-End: 336-570
tccaggcgctgctgccccaacacaggcgggcactctctgcgggtcccgcggctcccgcggcttccggcccactcagcgcctccagaggcctcaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatatt

SEQ ID NO: 130380 - DNA, 852 bp, Homo sapiens
  Payload ID: 5511
  Gene Symbol: EMC4
  Gene Name: ER membrane protein complex subunit 4
  Uniprot ID: Q5J8M3
  ENST ID: ENST00000249209
  CDS Start-End: 103-552
agtgcatttgcagagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgc

SEQ ID NO: 130381 - DNA, 1036 bp, Homo sapiens
  Payload ID: 5511
  Gene Symbol: EMC4
  Gene Name: ER membrane protein complex subunit 4
  Uniprot ID: Q5J8M3
  ENST ID: ENST00000267750
  CDS Start-End: 117-668
attcacgcgccggaagtgcatttgcagagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaa

SEQ ID NO: 130382 - DNA, 497 bp, Homo sapiens
  Payload ID: 5511
  Gene Symbol: EMC4
  Gene Name: ER membrane protein complex subunit 4
  ENST ID: ENST00000559421
  CDS Start-End: 50-286
gtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaa

SEQ ID NO: 130383 - DNA, 709 bp, Homo sapiens
  Payload ID: 5511
  Gene Symbol: EMC4
  Gene Name: ER membrane protein complex subunit 4
  ENST ID: ENST00000560947
  CDS Start-End: 1-295
ctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaa

SEQ ID NO: 130384 - DNA, 466 bp, Homo sapiens
  Payload ID: 5511
  Gene Symbol: EMC4
  Gene Name: ER membrane protein complex subunit 4
  ENST ID: ENST00000561372
  CDS Start-End: 91-466
gagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcagtttcttggtttggttttttaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagcca

SEQ ID NO: 130385 - DNA, 579 bp, Homo sapiens
  Payload ID: 5511
  Gene Symbol: EMC4
  Gene Name: ER membrane protein complex subunit 4
  ENST ID: ENST00000560911
  CDS Start-End: 98-316
atttgcagagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccc

SEQ ID NO: 130386 - DNA, 543 bp, Homo sapiens
  Payload ID: 5511
  Gene Symbol: EMC4
  Gene Name: ER membrane protein complex subunit 4
  ENST ID: ENST00000558102
  CDS Start-End: 76-207
gagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactat

SEQ ID NO: 130387 - DNA, 1006 bp, Homo sapiens
  Payload ID: 5511
  Gene Symbol: EMC4
  Gene Name: ER membrane protein complex subunit 4
  ENST ID: ENST00000558205
  CDS Start-End: 79-333
gcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaaggtacagagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaa

SEQ ID NO: 130388 - DNA, 599 bp, Homo sapiens
  Payload ID: 5511
  Gene Symbol: EMC4
  Gene Name: ER membrane protein complex subunit 4
  ENST ID: ENST00000559078
  CDS Start-End: 80-388
agcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggcgtgagccactgcgcctggcctagggtttcttaaaaaataagagccattaggagtttttaagttattatttttaattaattaattaatttatttattttgagacagagtctcactctgtcgcccaggctggagtacagtggtgtgatcttggctcactgcaacctccgccccccaggttcaagcgattcttgtgcctgagcctccctagtagctgg

SEQ ID NO: 130389 - DNA, 1009 bp, Homo sapiens
  Payload ID: 5511
  Gene Symbol: EMC4
  Gene Name: ER membrane protein complex subunit 4
  ENST ID: ENST00000557879
  CDS Start-End: 78-296
cggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaaggtacagaggttgcagtgagccgagatcgtgccactgcactccagcctgggtgacagaacgagactccatctcaaaaaaaaggaagaattaaaggtaaattcttagggacagtttttggctaacaggtatataggggagtggggtaatggtggtggcatggaggggagtgtagtgcttaccatggttttctgtttgcctttaatggtcctatttgctgtcttactatgggtctgtctatatgaatttaatatacagttggcttgattcgtattgggggaaagagttcttttggtttgacaacttctgttaccgcaacagctttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgaggtaaggcaaaagaaaagctgaattttgggtagttgtagtatacagtgaatagctgacctacttgatggtaggaaattggagttggtatttgagtttctttttttttttttttttttttttgagacggagtattgctctgtcgcccaggctggagtgcagtggcatgatctcggcaacctccgcctcctgggttcaagcaattattctgcctcagccttccaagtagctgggattacaggcacctgccaccat

SEQ ID NO: 130390 - DNA, 653 bp, Homo sapiens
  Payload ID: 5512
  Gene Symbol: EMC6
  Gene Name: ER membrane protein complex subunit 6
  Uniprot ID: Q9BV81
  ENST ID: ENST00000248378
  CDS Start-End: 135-467
cttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagaca

SEQ ID NO: 130391 - DNA, 762 bp, Homo sapiens
  Payload ID: 5512
  Gene Symbol: EMC6
  Gene Name: ER membrane protein complex subunit 6
  Uniprot ID: Q9BV81
  ENST ID: ENST00000397133
  CDS Start-End: 241-573
gcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacactt

SEQ ID NO: 130392 - DNA, 1155 bp, Homo sapiens
  Payload ID: 5513
  Gene Symbol: EMC7
  Gene Name: ER membrane protein complex subunit 7
  Uniprot ID: Q9NPA0
  ENST ID: ENST00000256545
  CDS Start-End: 110-838
cagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaatcaaa

SEQ ID NO: 130393 - DNA, 581 bp, Homo sapiens
  Payload ID: 5513
  Gene Symbol: EMC7
  Gene Name: ER membrane protein complex subunit 7
  ENST ID: ENST00000527822
  CDS Start-End: 1-577
cctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaaagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcag

SEQ ID NO: 130394 - DNA, 506 bp, Homo sapiens
  Payload ID: 5513
  Gene Symbol: EMC7
  Gene Name: ER membrane protein complex subunit 7
  ENST ID: ENST00000528949
  CDS Start-End: 27-506
cctgctgctgctgctgctatcgggggatgtccagagctcggaggacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaaca

SEQ ID NO: 130395 - DNA, 1962 bp, Homo sapiens
  Payload ID: 5514
  Gene Symbol: EMC8
  Gene Name: ER membrane protein complex subunit 8
  Uniprot ID: O43402
  ENST ID: ENST00000253457
  CDS Start-End: 246-878
tccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatcttgtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 130396 - DNA, 1935 bp, Homo sapiens
  Payload ID: 5514
  Gene Symbol: EMC8
  Gene Name: ER membrane protein complex subunit 8
  Uniprot ID: O43402
  ENST ID: ENST00000435200
  CDS Start-End: 314-694
ggtagcgctgcgaacgtcgtaaaatgccgggccgggctgctttccggcaggcgttggagaggctgctttccggcggcgccgggcgagaagcgcgactggagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggcgccgcgcggccaggcagcgggtccaggcctcagccgcgcgcccaggggcctccggggccctcccgggtcagcatgcccggggtgaaactgaccacccaggcctactgcaagatggtgctgcacggcgccaagtacccgcactgcgccgtcaacgggctcctggtggccgagaagcagaagccgcgtaaggagcacctccccctgggcggccccggcgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatgtgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatgtaaataaaatatcttgtagcctgtgtggaaagctgaccgttttaagaagtggcatgtgccttgaaagggggcagaatgttcagtcggtcgtgtttttaacacagagtctctagaagaggtgcagacatcccgtctgactgtccctgtggactctctcagttgtatgttgctataatcctccaaatcaaagctctttctgcttgtgcaagattgttcctattaaacagttttaactaaccttttataatctggagagaatactttttaaggcttttgaactatctttttttaaaaaaaaaaaaaaaagcccacatcttatactccaatgagtgtgtttgtgagtttttatcctgtttgaattttgatgtcgtccaggcgtcctgggatcagggtagacacgtggagtgctggtgctgagctgtttgagaagctctgtgtgggtgtttctgtggtcaggtaggctgggctgtgaacagcactgctccacatggtgtcggctcacagagccaccgcaactctgcccagcgggagtgacaccactgatgccacagaagcctttatcgttaggggcaaaagcagacatctctggtagcaggagctcagtgtggtgctcttcagccacgcagaaagctcacgtgcctgcagggccaggaaagggaaatgatcgtttcttttgtattaggaaaaacaagacttagacttcccgagttgtgcagagtgacgtctgtactttttatacttagaacatttggtcaagttttgtaaccaaaccttagggaattgagagggaaactttatggtacgtttaccttttttcctttttatatgaattattttgtacaaagttcagagagcggtacctttcctactgtcttttctttgactccatggaggaatttgtaacgatcggtgtgacctgaaagggtttgtgatacagcggtcactattttctcttaacacataggaaaaaagttcagacatcgctacaataaatgtgctttatttgatccaccaaa

SEQ ID NO: 130397 - DNA, 556 bp, Homo sapiens
  Payload ID: 5514
  Gene Symbol: EMC8
  Gene Name: ER membrane protein complex subunit 8
  ENST ID: ENST00000595980
  CDS Start-End: 1-303
gtggcctccagaatcgccgagggcttcagcgacactgcgctcatcatggtagacaacaccaagtttacgatggactgcgtagcgcctacgatccacgtgtacgagcaccatgagaacagatggcggtgcagagacccacaccatgactactgtgaagactggccagaggcacagaggatctcagcctcgctcctggacagccggtcctacgagacgctcgtggatttcgataaccacctggatgacattcggaatgactggacaaacccagagatcaataaagctgtcctacacttgtgctaggcaggcaccgctgtgactgggctccgggcctttccactacgttgaagaagaaaacctatttttaaatttcaatcaaatgcctggtaggaattgctagcgttgcccctgccaactctcagacggagtctcgcactgtcacccgattggagcacaatgccgcagtctcggttcactgcaacctccgcctgctgggttcaagcgattctcctgcctcagcctcccgagtagctgggattacaggcgcccgccacca

SEQ ID NO: 130398 - DNA, 835 bp, Homo sapiens
  Payload ID: 5515
  Gene Symbol: EMC9
  Gene Name: ER membrane protein complex subunit 9
  Uniprot ID: Q9Y3B6
  ENST ID: ENST00000216799
  CDS Start-End: 164-790
gtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 130399 - DNA, 953 bp, Homo sapiens
  Payload ID: 5515
  Gene Symbol: EMC9
  Gene Name: ER membrane protein complex subunit 9
  Uniprot ID: Q9Y3B6
  ENST ID: ENST00000419198
  CDS Start-End: 282-908
gcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 130400 - DNA, 771 bp, Homo sapiens
  Payload ID: 5515
  Gene Symbol: EMC9
  Gene Name: ER membrane protein complex subunit 9
  ENST ID: ENST00000560600
  CDS Start-End: 63-347
ggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagcaatatctgagcacctgtctcccacagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccac

SEQ ID NO: 130401 - DNA, 872 bp, Homo sapiens
  Payload ID: 5515
  Gene Symbol: EMC9
  Gene Name: ER membrane protein complex subunit 9
  ENST ID: ENST00000560403
  CDS Start-End: 423-827
gggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtggatgtgtggggagcacaggccggtctggtggtggctggttactaccatgccaatgcagctgtgaacgatcagagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 130402 - DNA, 2003 bp, Homo sapiens
  Payload ID: 5516
  Gene Symbol: ERMARD
  Gene Name: ER membrane-associated RNA degradation
  Uniprot ID: Q5T6L9
  ENST ID: ENST00000366772
  CDS Start-End: 37-1932
gtcattcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacaccaaccagcgatacgccgctagccctggctcccagaaagccgcagccttgcaggtgcagaaggagagtgaggcccagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacag

SEQ ID NO: 130403 - DNA, 2141 bp, Homo sapiens
  Payload ID: 5516
  Gene Symbol: ERMARD
  Gene Name: ER membrane-associated RNA degradation
  Uniprot ID: Q5T6L9
  ENST ID: ENST00000366773
  CDS Start-End: 34-2070
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacag

SEQ ID NO: 130404 - DNA, 1908 bp, Homo sapiens
  Payload ID: 5516
  Gene Symbol: ERMARD
  Gene Name: ER membrane-associated RNA degradation
  Uniprot ID: Q5T6L9
  ENST ID: ENST00000392095
  CDS Start-End: 243-1901
attcacgcgcgccgcagcggggcaccggaagttatggagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttg

SEQ ID NO: 130405 - DNA, 1841 bp, Homo sapiens
  Payload ID: 5516
  Gene Symbol: ERMARD
  Gene Name: ER membrane-associated RNA degradation
  Uniprot ID: Q5T6L9
  ENST ID: ENST00000418781
  CDS Start-End: 21-1838
gcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagactatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaa

SEQ ID NO: 130406 - DNA, 504 bp, Homo sapiens
  Payload ID: 5516
  Gene Symbol: ERMARD
  Gene Name: ER membrane-associated RNA degradation
  ENST ID: ENST00000590017
  CDS Start-End: 1-139
agtgtatgatataatttgtaatcttgggtttcaactcagagaaaattgtgatatcaatagcattgtaactcagaatggtgaagtatgctggaaaacaatcacagactgtgtgagctacacagagtcagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcac

SEQ ID NO: 130407 - DNA, 556 bp, Homo sapiens
  Payload ID: 5516
  Gene Symbol: ERMARD
  Gene Name: ER membrane-associated RNA degradation
  ENST ID: ENST00000590711
  CDS Start-End: 335-556
gtcattcacgcgcgccgcagcggggcaccggaagttatggagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcct

SEQ ID NO: 130408 - DNA, 552 bp, Homo sapiens
  Payload ID: 5516
  Gene Symbol: ERMARD
  Gene Name: ER membrane-associated RNA degradation
  ENST ID: ENST00000592745
  CDS Start-End: 468-552
attcacgcgcgccgcagcggggcaccggaagttatggagaggcatgttttgggatgacattgtggttttcttcaacaccgtttaggtagtcagaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatc

SEQ ID NO: 130409 - DNA, 552 bp, Homo sapiens
  Payload ID: 5516
  Gene Symbol: ERMARD
  Gene Name: ER membrane-associated RNA degradation
  ENST ID: ENST00000592315
  CDS Start-End: 34-255
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagt

SEQ ID NO: 130410 - DNA, 547 bp, Homo sapiens
  Payload ID: 5516
  Gene Symbol: ERMARD
  Gene Name: ER membrane-associated RNA degradation
  ENST ID: ENST00000588437
  CDS Start-End: 533-547
accggaagttatggagaactgtagatttgcagagaagtgacaggacacaggagagcagttttaggcttcaaagggcaggaaattgggaaggtagatacatattcggaaactaatggagtaagaattgtttgcagattcccctggtaccttaactggtctggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcg

SEQ ID NO: 130411 - DNA, 543 bp, Homo sapiens
  Payload ID: 5516
  Gene Symbol: ERMARD
  Gene Name: ER membrane-associated RNA degradation
  ENST ID: ENST00000586341
  CDS Start-End: 21-543
gcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagaggtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatac

SEQ ID NO: 130412 - DNA, 2146 bp, Homo sapiens
  Payload ID: 5516
  Gene Symbol: ERMARD
  Gene Name: ER membrane-associated RNA degradation
  ENST ID: ENST00000588451
  CDS Start-End: 514-2142
gctggcgacgtcgcggccctggcctctgtggcggtatcggacgctcggccctgcaagacgcctggcgggccctgccggcctccctgggccaggctcggtttctccgtcgcctcctggccctgagctggaacgcggcggacggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaac

SEQ ID NO: 130413 - DNA, 551 bp, Homo sapiens
  Payload ID: 5516
  Gene Symbol: ERMARD
  Gene Name: ER membrane-associated RNA degradation
  ENST ID: ENST00000592367
  CDS Start-End: 496-551
gtcattcacgcgcgccgcagcggggcaccggaagttatggagctcaaatttgttgttgtttttatatcgaagaggcatgttttgggatgacattgtggttttcttcaacaccgtttaggtagtcagaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgg

SEQ ID NO: 130414 - DNA, 1908 bp, Homo sapiens; identical to SEQ ID NO: 130404
  Payload ID: 5516
  Gene Symbol: ERMARD
  Gene Name: ER membrane-associated RNA degradation
  Uniprot ID: Q5T6L9
  ENST ID: ENST00000615090
  CDS Start-End: 243-1901

SEQ ID NO: 130415 - DNA, 2003 bp, Homo sapiens; identical to SEQ ID NO: 130402
  Payload ID: 5516
  Gene Symbol: ERMARD
  Gene Name: ER membrane-associated RNA degradation
  Uniprot ID: Q5T6L9
  ENST ID: ENST00000621205
  CDS Start-End: 37-1932

SEQ ID NO: 130416 - DNA, 1841 bp, Homo sapiens; identical to SEQ ID NO: 130405
  Payload ID: 5516
  Gene Symbol: ERMARD
  Gene Name: ER membrane-associated RNA degradation
  Uniprot ID: Q5T6L9
  ENST ID: ENST00000611694
  CDS Start-End: 21-1838

SEQ ID NO: 130417 - DNA, 2141 bp, Homo sapiens; identical to SEQ ID NO: 130403
  Payload ID: 5516
  Gene Symbol: ERMARD
  Gene Name: ER membrane-associated RNA degradation
  Uniprot ID: Q5T6L9
  ENST ID: ENST00000616801
  CDS Start-End: 34-2070

SEQ ID NO: 130418 - DNA, 552 bp, Homo sapiens; identical to SEQ ID NO: 130408
  Payload ID: 5516
  Gene Symbol: ERMARD
  Gene Name: ER membrane-associated RNA degradation
  ENST ID: ENST00000629254
  CDS Start-End: 468-552

SEQ ID NO: 130419 - DNA, 552 bp, Homo sapiens; identical to SEQ ID NO: 130409
  Payload ID: 5516
  Gene Symbol: ERMARD
  Gene Name: ER membrane-associated RNA degradation
  ENST ID: ENST00000629523
  CDS Start-End: 34-255

SEQ ID NO: 130420 - DNA, 2146 bp, Homo sapiens; identical to SEQ ID NO: 130412
  Payload ID: 5516
  Gene Symbol: ERMARD
  Gene Name: ER membrane-associated RNA degradation
  ENST ID: ENST00000630950
  CDS Start-End: 514-2142

SEQ ID NO: 130421 - DNA, 543 bp, Homo sapiens; identical to SEQ ID NO: 130411
  Payload ID: 5516
  Gene Symbol: ERMARD
  Gene Name: ER membrane-associated RNA degradation
  ENST ID: ENST00000628674
  CDS Start-End: 21-543

SEQ ID NO: 130422 - DNA, 547 bp, Homo sapiens; identical to SEQ ID NO: 130410
  Payload ID: 5516
  Gene Symbol: ERMARD
  Gene Name: ER membrane-associated RNA degradation
  ENST ID: ENST00000625212
  CDS Start-End: 533-547

SEQ ID NO: 130423 - DNA, 556 bp, Homo sapiens; identical to SEQ ID NO: 130407
  Payload ID: 5516
  Gene Symbol: ERMARD
  Gene Name: ER membrane-associated RNA degradation
  ENST ID: ENST00000628241
  CDS Start-End: 335-556

SEQ ID NO: 130424 - DNA, 504 bp, Homo sapiens; identical to SEQ ID NO: 130406
  Payload ID: 5516
  Gene Symbol: ERMARD
  Gene Name: ER membrane-associated RNA degradation
  ENST ID: ENST00000631324
  CDS Start-End: 1-139

SEQ ID NO: 130425 - DNA, 551 bp, Homo sapiens; identical to SEQ ID NO: 130413
  Payload ID: 5516
  Gene Symbol: ERMARD
  Gene Name: ER membrane-associated RNA degradation
  ENST ID: ENST00000627446
  CDS Start-End: 496-551

SEQ ID NO: 130426 - DNA, 1925 bp, Homo sapiens
  Payload ID: 5517
  Gene Symbol: ERAL1
  Gene Name: Era-like 12S mitochondrial rRNA chaperone 1
  Uniprot ID: O75616
  ENST ID: ENST00000254928
  CDS Start-End: 98-1411
gggcagacctacctctctcctactcgctggttcgtcagccgctctgttcaatcgtaggagcgctcctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggacgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctgtccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcctctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctcatcttta

SEQ ID NO: 130427 - DNA, 1039 bp, Homo sapiens
  Payload ID: 5517
  Gene Symbol: ERAL1
  Gene Name: Era-like 12S mitochondrial rRNA chaperone 1
  ENST ID: ENST00000412138
  CDS Start-End: 26-541
gttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtggtgggtacctacaaagggagtccttgaaacaggacagagggtgaagctaagagggtctcccttaccatcagccttgaagaaaatgatggtcacattcatttatattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaagga

SEQ ID NO: 130428 - DNA, 850 bp, Homo sapiens
  Payload ID: 5517
  Gene Symbol: ERAL1
  Gene Name: Era-like 12S mitochondrial rRNA chaperone 1
  ENST ID: ENST00000580917
  CDS Start-End: 1-850
cagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcag

SEQ ID NO: 130429 - DNA, 1628 bp, Homo sapiens
  Payload ID: 5517
  Gene Symbol: ERAL1
  Gene Name: Era-like 12S mitochondrial rRNA chaperone 1
  ENST ID: ENST00000461894
  CDS Start-End: 1-830
tggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctgtccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcctctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttct

SEQ ID NO: 130430 - DNA, 695 bp, Homo sapiens
  Payload ID: 5517
  Gene Symbol: ERAL1
  Gene Name: Era-like 12S mitochondrial rRNA chaperone 1
  ENST ID: ENST00000583487
  CDS Start-End: 1-243
cagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgggcattccagctcaagctgctggcaggaactgaccagttctgtccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcctctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 130431 - DNA, 3104 bp, Homo sapiens
  Payload ID: 5518
  Gene Symbol: ERRFI1
  Gene Name: ERBB receptor feedback inhibitor 1
  Uniprot ID: Q9UJM3
  ENST ID: ENST00000377482
  CDS Start-End: 225-1613
acggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgataccatta

SEQ ID NO: 130432 - DNA, 2097 bp, Homo sapiens
  Payload ID: 5518
  Gene Symbol: ERRFI1
  Gene Name: ERBB receptor feedback inhibitor 1
  ENST ID: ENST00000467067
  CDS Start-End: 15-254
cagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttggtatgtattctgaaaatctgatcacagtaagcatttgagaagaacagtctggattcgggttagcttgtcctccagcattattttttaaatgaggaaacctgaactatttccaacaacagcctgacccctagtggcaacagattcagaagataactgtgtttttctcaagctattgtactcgactgccttcattctgagtcactgattgctaagtaggactgttcatggacgtgggatcttctaaaatcaagaattagttctcattccagctctgatgcatactttacttcatgaaaccttaggcgagatttcccacctttcttactagtatcgaatgcatgtttgacagtaatagatgaaaatagtataaatgttcctcaaaacttaaaaaatagtatttttaatgtgaatattctgttccttggatctttgtcaagagctgtgtgtgaactgaacacattgcaggcaagtccattcactcacaatattatgatgtgccagcaataaggactttgtcttatctcattggtaccctacgtgcctagtatggtcgcatgtcttaaatggcaaggctggtacagtatggtattcatgtaaattatatgctattcatcttccgcgaattttacacacgtcacaaaacttgcctgtgatgtgtgggtgtgcgctgtgcacatgtccaagggagatagaggagatagtttgttctttgaaccacaccatgtgcgttaagaatcttctgctctctaattacacctgtggtggttgcatgggtgttctcggggtgacagcagtcaagtgtttcactcaggaagaaagctgtggaagcataggtagctggggtgctctctccctcacacaggtggagagaggattgttgatcttttattaatatctctcgttcattccagggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttc

SEQ ID NO: 130433 - DNA, 995 bp, Homo sapiens
  Payload ID: 5518
  Gene Symbol: ERRFI1
  Gene Name: ERBB receptor feedback inhibitor 1
  ENST ID: ENST00000469499
  CDS Start-End: 213-437
tgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaaggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagt

SEQ ID NO: 130434 - DNA, 479 bp, Homo sapiens
  Payload ID: 5518
  Gene Symbol: ERRFI1
  Gene Name: ERBB receptor feedback inhibitor 1
  ENST ID: ENST00000474874
  CDS Start-End: 200-361
gctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaatacaggcagaaaactacctggcactgtgggagactgagtataggagaaagcaggatgacgatgggcctgaatggtggtgtgttttcctccacacaatgtggctttgtcctccaaggtgtctcacgtgatggaagctggctgatctgacttgcttg

SEQ ID NO: 130435 - DNA, 787 bp, Homo sapiens
  Payload ID: 5518
  Gene Symbol: ERRFI1
  Gene Name: ERBB receptor feedback inhibitor 1
  ENST ID: ENST00000487559
  CDS Start-End: 213-371
tgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacttcctctcctttcagcaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactcta

SEQ ID NO: 130436 - DNA, 8647 bp, Homo sapiens
  Payload ID: 5519
  Gene Symbol: ERBB2IP
  Gene Name: erbb2 interacting protein
  Uniprot ID: Q96RT1
  ENST ID: ENST00000284037
  CDS Start-End: 390-4628
ggacggagctggatcctgcttctcgccaaggcaggaagtgagtttcgcactgcaattccgggcggtgtcacgagtgaaaagttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaggaagtggagaagacatttttagtttatatattgttgagtaaattgtagttaaggcctatacccataactaactttagtaagtattatatagcaattcatcaaaaccacaactgtcttttagtgattttgtctttaagagtaatttcttactctaaccagtaaaaaaataatactgatcagagtaatttatacggcatacaatagttgatacaatctaaagatttatgctaattaaggaattatcacttcatctgaatcaatgaaattctaaaattccctacatatttattttgtaaatattcttctgacctctttggactggatatgaagatatatatatatacacttaattcttttaaacacaaaacttgccataagcagaaccaaacttttaagtattaatttgctgcacttaaaaaatcccattagcagctatgtaatatttttatcaaccaacatttattcattccaaatttttgtatatatctagatgaagtaacacatagaggatagataacaaactaatgatgtttaaactggtttatttacaaaattcggggttagagaaattctcatgaaaaatatacaatttttttttagcattaaaaccctgtatatctaggtgtggaagaagtgtagtttatctcaaattattattatttacttctaaagggaggcattaagatgggaaatgtttctctgatggagattgacgtgtgaaatctatttggaagggtatttttttcactcagtctgttgcattcttacagccttctgttttaatgttcagtgaataggtttcttatgaaatggacattgaaataaaaattatgattcaagagcattaattgatgaacaagtgaacaagatgcctctttaaaaaaaaaaaagaaaaagtaatctagacaggcagccaactcagacctttgggtattcctttgtttctaaataaggaccttcagaaaaagttgaccatattctacctaaagctgctaattctttacagaattcataagcccaggggatagtaagtagtcatttagttttggaaagttcttaagagaatgctatcttctacagtctcatgaagcagtttttcaagattagaatctgtggtcagctataacgtacagtcctaatatccaaccacctgagaagctcatcctaagctgagaaagcctaaaatgttagagaatgtttagagaaaacacctgaaattttttttaagagaacaacctaggttttattgtagagaacaatcaaaatactcctgaacctttctatagaatctttaggagagaggctgacaaaaagaatccttctgttacaactttcttttctaatgtaacaaccagggacaatggtgatctgtcacgcatctgcccatctagcttctcaatcggcccacggttttatttcaggataaaatttgagaaactagtatcactggggaaggaagaaacctaagctgtaaaattatgcttttcccctcaagggattcaataaagcttatttttcatgaaaacaa

SEQ ID NO: 130437 - DNA, 6692 bp, Homo sapiens
  Payload ID: 5519
  Gene Symbol: ERBB2IP
  Gene Name: erbb2 interacting protein
  Uniprot ID: Q96RT1
  ENST ID: ENST00000380935
  CDS Start-End: 291-4199
cggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgagga

SEQ ID NO: 130438 - DNA, 4701 bp, Homo sapiens
  Payload ID: 5519
  Gene Symbol: ERBB2IP
  Gene Name: erbb2 interacting protein
  Uniprot ID: Q96RT1
  ENST ID: ENST00000380938
  CDS Start-End: 255-4295
aaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatgctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttatt

SEQ ID NO: 130439 - DNA, 6410 bp, Homo sapiens
  Payload ID: 5519
  Gene Symbol: ERBB2IP
  Gene Name: erbb2 interacting protein
  Uniprot ID: Q96RT1
  ENST ID: ENST00000380943
  CDS Start-End: 309-4424
ttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaa

SEQ ID NO: 130440 - DNA, 2351 bp, Homo sapiens
  Payload ID: 5519
  Gene Symbol: ERBB2IP
  Gene Name: erbb2 interacting protein
  ENST ID: ENST00000416865
  CDS Start-End: 298-2130
tttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttagg

SEQ ID NO: 130441 - DNA, 4374 bp, Homo sapiens
  Payload ID: 5519
  Gene Symbol: ERBB2IP
  Gene Name: erbb2 interacting protein
  Uniprot ID: Q96RT1
  ENST ID: ENST00000508515
  CDS Start-End: 60-3968
agaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttatt

SEQ ID NO: 130442 - DNA, 4257 bp, Homo sapiens
  Payload ID: 5519
  Gene Symbol: ERBB2IP
  Gene Name: erbb2 interacting protein
  Uniprot ID: Q96RT1
  ENST ID: ENST00000511297
  CDS Start-End: 138-4241
caaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaa

SEQ ID NO: 130443 - DNA, 474 bp, Homo sapiens
  Payload ID: 5519
  Gene Symbol: ERBB2IP
  Gene Name: erbb2 interacting protein
  ENST ID: ENST00000512354
  CDS Start-End: 1-474
agcatgctgtcaaggtcctttaattccaattttactactgtaagcagttttcactgtggcagctctagggatctgcatggcagccagggcagtcttgccttgagtgttgcagacagaagaggttctggtgggcacatttttcgaaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagag

SEQ ID NO: 130444 - DNA, 589 bp, Homo sapiens
  Payload ID: 5519
  Gene Symbol: ERBB2IP
  Gene Name: erbb2 interacting protein
  ENST ID: ENST00000511671
  CDS Start-End: 1-589
atcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaaagcatccccagacatccagttcaggagatccttgtcaagatggtatattcatttcaggacagcagaactactcatcagccacacttagtcacaaagatgttcctccagacagcttgatgaaagtg

SEQ ID NO: 130445 - DNA, 4386 bp, Homo sapiens
  Payload ID: 5519
  Gene Symbol: ERBB2IP
  Gene Name: erbb2 interacting protein
  Uniprot ID: Q96RT1
  ENST ID: ENST00000506030
  CDS Start-End: 92-4351
aaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaag

SEQ ID NO: 130446 - DNA, 4545 bp, Homo sapiens
  Payload ID: 5520
  Gene Symbol: ERBB2
  Gene Name: erb-b2 receptor tyrosine kinase 2
  Uniprot ID: P04626
  ENST ID: ENST00000269571
  CDS Start-End: 160-3927
ggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 130447 - DNA, 4564 bp, Homo sapiens
  Payload ID: 5520
  Gene Symbol: ERBB2
  Gene Name: erb-b2 receptor tyrosine kinase 2
  Uniprot ID: P04626
  ENST ID: ENST00000406381
  CDS Start-End: 269-3946
taccaaatccgaaaatattgtgaccaggaaccattctgtccaactcttctatttcaggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 130448 - DNA, 3238 bp, Homo sapiens
  Payload ID: 5520
  Gene Symbol: ERBB2
  Gene Name: erb-b2 receptor tyrosine kinase 2
  ENST ID: ENST00000445658
  CDS Start-End: 264-3203
gcgcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgt

SEQ ID NO: 130449 - DNA, 4341 bp, Homo sapiens
  Payload ID: 5520
  Gene Symbol: ERBB2
  Gene Name: erb-b2 receptor tyrosine kinase 2
  Uniprot ID: P04626
  ENST ID: ENST00000541774
  CDS Start-End: 1-3723
atgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 130450 - DNA, 1013 bp, Homo sapiens
  Payload ID: 5520
  Gene Symbol: ERBB2
  Gene Name: erb-b2 receptor tyrosine kinase 2
  ENST ID: ENST00000582648
  CDS Start-End: 166-456
gggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcagacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggc

SEQ ID NO: 130451 - DNA, 583 bp, Homo sapiens
  Payload ID: 5520
  Gene Symbol: ERBB2
  Gene Name: erb-b2 receptor tyrosine kinase 2
  ENST ID: ENST00000584099
  CDS Start-End: 167-583
gaatgcacagggtgggcctagtcagaagaagcctttcccctgaaatccctctacttcccaagcacgcaagctttctcctgctgttaaacctgcagtgtgcaagggacatgggcggaggggtccttcagtcaggcttctccctgtctgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtgg

SEQ ID NO: 130452 - DNA, 4792 bp, Homo sapiens
  Payload ID: 5520
  Gene Symbol: ERBB2
  Gene Name: erb-b2 receptor tyrosine kinase 2
  Uniprot ID: P04626
  ENST ID: ENST00000584601
  CDS Start-End: 798-4475
agtacgcagtcgcggtacaccggctcacggtcgccctgggagccgctcgccagcgccgctgccccagctagcaggaccaaccgcgccgccaggccggccatcctttctccctggctcgccgccgggggaggagcttaggagtatgaagcttccacttccggagtaaccggaagttcctgtgttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagatacttcaaagattccagaagatatgccccgggggtcctggaagccacaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagcctt

SEQ ID NO: 130453 - DNA, 2526 bp, Homo sapiens
  Payload ID: 5520
  Gene Symbol: ERBB2
  Gene Name: erb-b2 receptor tyrosine kinase 2
  ENST ID: ENST00000578199
  CDS Start-End: 542-2353
gtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttccatgatcttttttgagtcgcaattgaagtaccacctcccgagggtgattgcttccccatgcggggtagaacctttgctgtcctgttcaccactctacctccagcacagaatttggcttatgcctactcaatgtgaagatgatgaggatgaaaacctttgtgatgatccacttccacttaatgaatggtggcaaagcaaagctatattcaagaccacatgcaaagctactccctgagcaaagagtcacagataaaacgggggcaccagtagaatggccaggacaaacgcagtgcagcacagagactcagaccctggcagccatgcctgcgcaggcagtgatgagagtgacatgtactgttgtggacatgcacaaaagtgagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcgtgagtccaacggtcttttctgcagaaaggaggactttcctttcaggggtctttctggggctcttactataaaaggggaccaactctccctttgtcatatcttgtttctgatgacaaaaataacacattgttaaaattgtaaaattaaaacatgaaatataaattaatgccctagca

SEQ ID NO: 130454 - DNA, 754 bp, Homo sapiens
  Payload ID: 5520
  Gene Symbol: ERBB2
  Gene Name: erb-b2 receptor tyrosine kinase 2
  ENST ID: ENST00000580074
  CDS Start-End: 1-754
ttccagatgaggagggcgcatgccagccttgccccatcaactgcacccactcccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaa

SEQ ID NO: 130455 - DNA, 4523 bp, Homo sapiens
  Payload ID: 5520
  Gene Symbol: ERBB2
  Gene Name: erb-b2 receptor tyrosine kinase 2
  ENST ID: ENST00000578373
  CDS Start-End: 160-432
ggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggtgaggcccgtgggcaacccagccaggccctgcctccagctgggctgagccctctgtttacaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaa

SEQ ID NO: 130456 - DNA, 3730 bp, Homo sapiens
  Payload ID: 5520
  Gene Symbol: ERBB2
  Gene Name: erb-b2 receptor tyrosine kinase 2
  ENST ID: ENST00000584450
  CDS Start-End: 216-3383
gcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtga

SEQ ID NO: 130457 - DNA, 559 bp, Homo sapiens
  Payload ID: 5520
  Gene Symbol: ERBB2
  Gene Name: erb-b2 receptor tyrosine kinase 2
  ENST ID: ENST00000578709
  CDS Start-End: 253-559
acacagggctgtgggtgagagagacagctgaagtgtcagcgtgaggggccagtgtggggctgcggctgggagggctggggtggggcccagggtagttgtgcctgtccttgggtgatggaatgatctggaaagagattccttccctgccctccacctgtgagaagcccctctagagtgacatctccatcttatgtttggccacccatcctccccctgggaagagagccgaggtgggtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcct

SEQ ID NO: 130458 - DNA, 529 bp, Homo sapiens
  Payload ID: 5520
  Gene Symbol: ERBB2
  Gene Name: erb-b2 receptor tyrosine kinase 2
  ENST ID: ENST00000582818
  CDS Start-End: 1-529
gccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaagggcatctggatccctgatggggagaatgtgaaaattcca

SEQ ID NO: 130459 - DNA, 497 bp, Homo sapiens
  Payload ID: 5520
  Gene Symbol: ERBB2
  Gene Name: erb-b2 receptor tyrosine kinase 2
  ENST ID: ENST00000578502
  CDS Start-End: 1-497
accacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggagtctcactctgtcagcaggctggagtgcagtggtacgatcttggctcactgcaacctctgcctcctggattcaagcaattctcctgcctcagtctcctgagtagctgggactacagggaccca

SEQ ID NO: 130460 - DNA, 5919 bp, Homo sapiens
  Payload ID: 5521
  Gene Symbol: ERBB3
  Gene Name: erb-b2 receptor tyrosine kinase 3
  Uniprot ID: P21860
  ENST ID: ENST00000267101
  CDS Start-End: 441-4469
attacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttca

SEQ ID NO: 130461 - DNA, 4353 bp, Homo sapiens
  Payload ID: 5521
  Gene Symbol: ERBB3
  Gene Name: erb-b2 receptor tyrosine kinase 3
  Uniprot ID: P21860
  ENST ID: ENST00000415288
  CDS Start-End: 221-4072
atttattccaggacctagagagaggcaggatgagggtagagaattaaccccttagtacccaaaagaagcacagaggggtcccaggttgaaaaaggaaatcttttcaccttcccattcatggaatgtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctg

SEQ ID NO: 130462 - DNA, 1027 bp, Homo sapiens
  Payload ID: 5521
  Gene Symbol: ERBB3
  Gene Name: erb-b2 receptor tyrosine kinase 3
  Uniprot ID: P21860
  ENST ID: ENST00000411731
  CDS Start-End: 165-716
tccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaattagctggc

SEQ ID NO: 130463 - DNA, 2755 bp, Homo sapiens
  Payload ID: 5521
  Gene Symbol: ERBB3
  Gene Name: erb-b2 receptor tyrosine kinase 3
  Uniprot ID: P21860
  ENST ID: ENST00000551242
  CDS Start-End: 97-1092
aattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaa

SEQ ID NO: 130464 - DNA, 4382 bp, Homo sapiens
  Payload ID: 5521
  Gene Symbol: ERBB3
  Gene Name: erb-b2 receptor tyrosine kinase 3
  ENST ID: ENST00000551085
  CDS Start-End: 134-2899
atttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatgg

SEQ ID NO: 130465 - DNA, 561 bp, Homo sapiens
  Payload ID: 5521
  Gene Symbol: ERBB3
  Gene Name: erb-b2 receptor tyrosine kinase 3
  ENST ID: ENST00000549282
  CDS Start-End: 183-561
attcattacccttccctggatctgggggctttcggaatctcgacctccccttggcctatctcctgcagaaaaattaggcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaact

SEQ ID NO: 130466 - DNA, 572 bp, Homo sapiens
  Payload ID: 5521
  Gene Symbol: ERBB3
  Gene Name: erb-b2 receptor tyrosine kinase 3
  ENST ID: ENST00000550869
  CDS Start-End: 135-266
aatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtg

SEQ ID NO: 130467 - DNA, 3289 bp, Homo sapiens
  Payload ID: 5521
  Gene Symbol: ERBB3
  Gene Name: erb-b2 receptor tyrosine kinase 3
  ENST ID: ENST00000549832
  CDS Start-End: 457-1845
aaaaaaaaaaaattagccaggcgtggcggcatgcatctgtactcccagctactcgggaggctgaggcaggagaatggcgtgaacccaggaggcggagcttgcagtgggccgagatcgcaccactgcactccagtctgggcgacagagcgagactccgtctcaaaaaaaaaaaaaaaagaatttgggacttggaaatcctaagaaaatttgtggaaataaacttgtgatacctctatctttaatccgcagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagtttt

SEQ ID NO: 130468 - DNA, 2729 bp, Homo sapiens
  Payload ID: 5521
  Gene Symbol: ERBB3
  Gene Name: erb-b2 receptor tyrosine kinase 3
  ENST ID: ENST00000550070
  CDS Start-End: 1-1950
tgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaa

SEQ ID NO: 130469 - DNA, 3237 bp, Homo sapiens
  Payload ID: 5521
  Gene Symbol: ERBB3
  Gene Name: erb-b2 receptor tyrosine kinase 3
  ENST ID: ENST00000553131
  CDS Start-End: 735-2486
agaacactggtcagagaaatgggaggcatgcattctagtcctgattttgccattaatttgccacatgactttgaagaagttacttatcttctctgtgcctcggtttatgcatctatacagaggaaataacatttgtccttccaggatggctgtaagggtaaagggggatgatgtatgtgaaagtgctttggaaagcacagagcactgtataaaaggtactcaaggtggtaatagtactaccaactctccctagctgtccccttccccactttgtgctcctccatcaaagggaaaacccaacccctttgattcctgatctcatgagcacaaataacttcctcagttctcagggtctgtacctcaatatgcctataatccattccaggactaacggtgcttcctcttcctgccctttcagctgtgctgcttttggcattcacctatgaggagcgggttggagtgggacatgggaatggcctttcctgagtaactccttcccatttgctcctcagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctcttt

SEQ ID NO: 130470 - DNA, 560 bp, Homo sapiens
  Payload ID: 5521
  Gene Symbol: ERBB3
  Gene Name: erb-b2 receptor tyrosine kinase 3
  ENST ID: ENST00000549061
  CDS Start-End: 212-560
attcattacccttccctggatctgggggctttcggaatctcgacctccccttggcctatctcctgcagaaaaattaggcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtgg

SEQ ID NO: 130471 - DNA, 676 bp, Homo sapiens
  Payload ID: 5521
  Gene Symbol: ERBB3
  Gene Name: erb-b2 receptor tyrosine kinase 3
  ENST ID: ENST00000549672
  CDS Start-End: 332-676
agagatatttattccaggacctagagagaggcaggatgagggtagagaagtgagtgccctagttggagggggagaggagggtaatcaaagttgcggccttttcctaacttctcttttctagggagagaaacaaattccctgtcttccttctcagttaaccccttagtacccaaaagaagcacagaggggtcccaggttgaaaaaggaaatcttttcaccttcccattcatggaatgtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagata

SEQ ID NO: 130472 - DNA, 266 bp, Homo sapiens
  Payload ID: 5521
  Gene Symbol: ERBB3
  Gene Name: erb-b2 receptor tyrosine kinase 3
  ENST ID: ENST00000550828
  CDS Start-End: 1-246
ctagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttct

SEQ ID NO: 130473 - DNA, 2194 bp, Homo sapiens
  Payload ID: 5522
  Gene Symbol: ERBB4
  Gene Name: erb-b2 receptor tyrosine kinase 4
  ENST ID: ENST00000260943
  CDS Start-End: 1-2194
tgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgcataggctcaagtattgaagactgcatcggcctgatggatagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggaga

SEQ ID NO: 130474 - DNA, 12136 bp, Homo sapiens
  Payload ID: 5522
  Gene Symbol: ERBB4
  Gene Name: erb-b2 receptor tyrosine kinase 4
  Uniprot ID: Q15303
  ENST ID: ENST00000342788
  CDS Start-End: 312-4238
ggagcgagcaagcgaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaacgtt

SEQ ID NO: 130475 - DNA, 11755 bp, Homo sapiens
  Payload ID: 5522
  Gene Symbol: ERBB4
  Gene Name: erb-b2 receptor tyrosine kinase 4
  ENST ID: ENST00000402597
  CDS Start-End: 108-3857
ttgtctttgcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaacgtt

SEQ ID NO: 130476 - DNA, 12084 bp, Homo sapiens
  Payload ID: 5522
  Gene Symbol: ERBB4
  Gene Name: erb-b2 receptor tyrosine kinase 4
  Uniprot ID: Q15303
  ENST ID: ENST00000436443
  CDS Start-End: 312-4190
ggagcgagcaagcgaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaa

SEQ ID NO: 130477 - DNA, 569 bp, Homo sapiens
  Payload ID: 5522
  Gene Symbol: ERBB4
  Gene Name: erb-b2 receptor tyrosine kinase 4
  ENST ID: ENST00000435846
  CDS Start-End: 185-569
atttgttctcctggttccctctctgtgagatcttcttaatctgtgtctttcaagggaaggtcattgctgctctgaaggaagctgcattttgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggac

SEQ ID NO: 130478 - DNA, 868 bp, Homo sapiens; identical to SEQ ID NO: 129445
  Payload ID: 5523
  Gene Symbol:
  Gene Name: ERC1
  ENST ID: ENST00000635679
  CDS Start-End: 433-868

SEQ ID NO: 130479 - DNA, 4955 bp, Homo sapiens; identical to SEQ ID NO: 129436
  Payload ID: 5523
  Gene Symbol:
  Gene Name: ERC1
  ENST ID: ENST00000634346
  CDS Start-End: 407-3253

SEQ ID NO: 130480 - DNA, 2881 bp, Homo sapiens; identical to SEQ ID NO: 129443
  Payload ID: 5523
  Gene Symbol:
  Gene Name: ERC1
  ENST ID: ENST00000635459
  CDS Start-End: 207-2369

SEQ ID NO: 130481 - DNA, 1275 bp, Homo sapiens; identical to SEQ ID NO: 129449
  Payload ID: 5523
  Gene Symbol:
  Gene Name: ERC1
  ENST ID: ENST00000635535
  CDS Start-End: 244-1275

SEQ ID NO: 130482 - DNA, 2071 bp, Homo sapiens; identical to SEQ ID NO: 129448
  Payload ID: 5523
  Gene Symbol:
  Gene Name: ERC1
  ENST ID: ENST00000635646
  CDS Start-End: 1-857

SEQ ID NO: 130483 - DNA, 9202 bp, Homo sapiens; identical to SEQ ID NO: 129450
  Payload ID: 5523
  Gene Symbol:
  Gene Name: ERC1
  ENST ID: ENST00000635644
  CDS Start-End: 158-3508

SEQ ID NO: 130484 - DNA, 9241 bp, Homo sapiens; identical to SEQ ID NO: 129441
  Payload ID: 5523
  Gene Symbol:
  Gene Name: ERC1
  ENST ID: ENST00000635703
  CDS Start-End: 272-3538

SEQ ID NO: 130485 - DNA, 7040 bp, Homo sapiens; identical to SEQ ID NO: 129440
  Payload ID: 5523
  Gene Symbol:
  Gene Name: ERC1
  ENST ID: ENST00000635345
  CDS Start-End: 378-3356

SEQ ID NO: 130486 - DNA, 4390 bp, Homo sapiens; identical to SEQ ID NO: 129442
  Payload ID: 5523
  Gene Symbol:
  Gene Name: ERC1
  ENST ID: ENST00000634365
  CDS Start-End: 529-3891

SEQ ID NO: 130487 - DNA, 5789 bp, Homo sapiens; identical to SEQ ID NO: 129438
  Payload ID: 5523
  Gene Symbol:
  Gene Name: ERC1
  ENST ID: ENST00000635430
  CDS Start-End: 182-3532

SEQ ID NO: 130488 - DNA, 550 bp, Homo sapiens; identical to SEQ ID NO: 129447
  Payload ID: 5523
  Gene Symbol:
  Gene Name: ERC1
  ENST ID: ENST00000634786
  CDS Start-End: 1-269

SEQ ID NO: 130489 - DNA, 4323 bp, Homo sapiens; identical to SEQ ID NO: 129444
  Payload ID: 5523
  Gene Symbol:
  Gene Name: ERC1
  ENST ID: ENST00000634904
  CDS Start-End: 529-3459

SEQ ID NO: 130490 - DNA, 9118 bp, Homo sapiens; identical to SEQ ID NO: 129439
  Payload ID: 5523
  Gene Symbol:
  Gene Name: ERC1
  ENST ID: ENST00000634945
  CDS Start-End: 158-3424

SEQ ID NO: 130491 - DNA, 5796 bp, Homo sapiens; identical to SEQ ID NO: 129437
  Payload ID: 5523
  Gene Symbol:
  Gene Name: ERC1
  ENST ID: ENST00000635531
  CDS Start-End: 133-3393

SEQ ID NO: 130492 - DNA, 546 bp, Homo sapiens; identical to SEQ ID NO: 129446
  Payload ID: 5523
  Gene Symbol:
  Gene Name: ERC1
  ENST ID: ENST00000635607
  CDS Start-End: 278-546

SEQ ID NO: 130493 - DNA, 2832 bp, Homo sapiens; identical to SEQ ID NO: 129451
  Payload ID: 5523
  Gene Symbol:
  Gene Name: ERC1
  ENST ID: ENST00000635106
  CDS Start-End: 158-2320

SEQ ID NO: 130494 - DNA, 3411 bp, Homo sapiens
  Payload ID: 5524
  Gene Symbol: ERCC6-PGBD3
  Gene Name: ERCC6-PGBD3 readthrough
  ENST ID: ENST00000447839
  CDS Start-End: 94-3279
acggcccgtcgagctgggttccaaggcggctggcggcggtagcgtctctgtttccttgtgggcgctcgcgcggccctgggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaagtcccaagatgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttctaatttgcatgttgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacagagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaactggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttc

SEQ ID NO: 130495 - DNA, 3439 bp, Homo sapiens
  Payload ID: 5524
  Gene Symbol: ERCC6-PGBD3
  Gene Name: ERCC6-PGBD3 readthrough
  ENST ID: ENST00000515869
  CDS Start-End: 122-3307
aggtgcgcgcgtggcggagggggaacagagaagcaggacagctctccatccttcccgtgttcagtcgtgggagacaacaagagaggtcacagcctggcgaccaaaaagtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaagtcccaagatgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttctaatttgcatgttgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacagagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaactggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttc

SEQ ID NO: 130496 - DNA, 5014 bp, Homo sapiens
  Payload ID: 5525
  Gene Symbol: ERGIC2
  Gene Name: ERGIC and golgi 2
  Uniprot ID: Q96RQ1
  ENST ID: ENST00000360150
  CDS Start-End: 77-1210
tctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttactaatgcaaacaagatttacagtctttaatacaatcttaattttggaattcatgaaggaatgactaagttctaatttttttttttttttttttgaaactgagtctcgctctgtcgcctaggctggagtgcagtggtgcaatctcagctcactgcaacctccgtctcccgggttcaagtgattctcctgcctcagcctgttgagtagctgggactacaggtgcgtaccaccaagcccagctaatttttttatatttttagtagagacggggtttcactgtgttagccaggatggtctcaatctcctgacctcatgatccgcccaccttggcctcccaaagtgttgggattacaggcatgagccactgcccctggacagatctaattttttaatagtgtaagagagatacactgtgcattccatctatgtcctgagttagtaattcaagtaccaaaaagtaatttaatatgaaactccttgaaaattcagagcttacacttgaattcaaaatgcctatttttgattgtttaaaagttacttaaacctgagctttaggacctttaaaatctcagcatgccttttaagctagtacttttcctgttttgagctctagcaaaccttcagcaagccaaggtggtagccctttttcaacacaatcaaaatagagaggtcaccagttgtttactaccttatggtaaaatgcccggatcaagatccatgtatcccccccatattgtgatgatgcaatcaaagcatagtttttttctactttctgaaatattactgatgaaatcactttacatttaagaggagaaaacagactgccttggattttttttttgtcttgagagaaaaaacaaaatatttagtattgcaagcataaacatttggactcaataaatgacaaattatgaaa

SEQ ID NO: 130497 - DNA, 616 bp, Homo sapiens
  Payload ID: 5525
  Gene Symbol: ERGIC2
  Gene Name: ERGIC and golgi 2
  ENST ID: ENST00000550353
  CDS Start-End: 99-616
gggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaa

SEQ ID NO: 130498 - DNA, 308 bp, Homo sapiens
  Payload ID: 5525
  Gene Symbol: ERGIC2
  Gene Name: ERGIC and golgi 2
  ENST ID: ENST00000546509
  CDS Start-End: 1-172
ggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcttttttttgtattctagacaaccagatgttccaatattttattacagttgtgccaacaaaactacatacatataaaatatcagcagacacccatcagttttctgtgacagaaagggaacgtatcattaaccatgctgcaggcagccatggagt

SEQ ID NO: 130499 - DNA, 565 bp, Homo sapiens
  Payload ID: 5525
  Gene Symbol: ERGIC2
  Gene Name: ERGIC and golgi 2
  ENST ID: ENST00000549182
  CDS Start-End: 1-150
gaacgtatcattaaccatgctgcaggcagccatggagtctctgggatatttatgaaatatgatctcagttctcttatggtgacagttactgaggagcacatgccattctggcagttttttgcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcaga

SEQ ID NO: 130500 - DNA, 695 bp, Homo sapiens
  Payload ID: 5525
  Gene Symbol: ERGIC2
  Gene Name: ERGIC and golgi 2
  ENST ID: ENST00000552132
  CDS Start-End: 170-695
atttccgggtacgcgggagccccggcgacccgggcttctgtgaaacatggcggtaggctgggaccataacacaaggttattgtcataggataaattcctcaatgggcatttacttagaagaggagtggtgtgcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatc

SEQ ID NO: 130501 - DNA, 432 bp, Homo sapiens
  Payload ID: 5525
  Gene Symbol: ERGIC2
  Gene Name: ERGIC and golgi 2
  ENST ID: ENST00000548441
  CDS Start-End: 218-432
gtacgcgggagccccggcgacccgggcttctgtgaaacatggcggtaggctgggaccataacacaagagtttcaggccaggtgtggtggttcacatctataatcccagcactttttttgagaggccgaggtgggtggaaggcttcagcccaggagtttgagacccagcctgggcaacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctag

SEQ ID NO: 130502 - DNA, 765 bp, Homo sapiens
  Payload ID: 5525
  Gene Symbol: ERGIC2
  Gene Name: ERGIC and golgi 2
  ENST ID: ENST00000551467
  CDS Start-End: 1-629
tatttaaaagtgcttttaaaagtacatcaacagctcttccaccaagagaagatgattcatcacagtctccaaatgcatgcagaattcatggccatctatatgtcaataaagtagcagggaattttcacataacagtgggcaaaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaa

SEQ ID NO: 130503 - DNA, 645 bp, Homo sapiens
  Payload ID: 5525
  Gene Symbol: ERGIC2
  Gene Name: ERGIC and golgi 2
  ENST ID: ENST00000548909
  CDS Start-End: 1-490
ggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaa

SEQ ID NO: 130504 - DNA, 693 bp, Homo sapiens
  Payload ID: 5525
  Gene Symbol: ERGIC2
  Gene Name: ERGIC and golgi 2
  ENST ID: ENST00000552155
  CDS Start-End: 85-693
cccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagggcaattccacatcctcgtggtcatgcacatttggcagcacttgtcaaccatgaatcttacaatttttctcatagaatagatcatttgtcttttggagagcttgttccagcaattattaatcctttagatgga

SEQ ID NO: 130505 - DNA, 1274 bp, Homo sapiens
  Payload ID: 5525
  Gene Symbol: ERGIC2
  Gene Name: ERGIC and golgi 2
  ENST ID: ENST00000546839
  CDS Start-End: 614-1274
gtgaaacatggcggtaggctgggaccataacacaaggtaaaatactgaaacaccgctgggtgctgttccctcggttgttccagggctgtttagggcgtaaatgcaattgagggaactgggagcctgtcatgggcttggcttcctgtcttcattgatctctagagagccggtcggacggagaagccgctccacctcccacgggggcgttactggcaggaccctaggcaacgatgctactgggagcttccctttgccaggtccgggtgcttgtgtgctatcctgcaactcgaaggagttcaggtgcttcctcgatcgcacctgattctgaccctttgcttgtcacagtgcccggttcccaggtggtttctccagtccgcaggcgagtaggatcccaatcggtcgagtcccagtcctcccggatgtcagactccctacccccattcagacaaatgccacattcgtggcagcacgttgccctctgtctctttaagagtcttggccttgcccggaaggagtttcgcacagtgcttcggaaaatgagaagggggcgggggagggcgagatgctgagagacagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgt

SEQ ID NO: 130506 - DNA, 4961 bp, Homo sapiens
  Payload ID: 5525
  Gene Symbol: ERGIC2
  Gene Name: ERGIC and golgi 2
  ENST ID: ENST00000611644
  CDS Start-End: 1-1161
atgaaggaagaggaaggttttcctgaagatgaggcgactgaatcggaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttactaatgcaaacaagatttacagtctttaatacaatcttaattttggaattcatgaaggaatgactaagttctaatttttttttttttttttttgaaactgagtctcgctctgtcgcctaggctggagtgcagtggtgcaatctcagctcactgcaacctccgtctcccgggttcaagtgattctcctgcctcagcctgttgagtagctgggactacaggtgcgtaccaccaagcccagctaatttttttatatttttagtagagacggggtttcactgtgttagccaggatggtctcaatctcctgacctcatgatccgcccaccttggcctcccaaagtgttgggattacaggcatgagccactgcccctggacagatctaattttttaatagtgtaagagagatacactgtgcattccatctatgtcctgagttagtaattcaagtaccaaaaagtaatttaatatgaaactccttgaaaattcagagcttacacttgaattcaaaatgcctatttttgattgtttaaaagttacttaaacctgagctttaggacctttaaaatctcagcatgccttttaagctagtacttttcctgttttgagctctagcaaaccttcagcaagccaaggtggtagccctttttcaacacaatcaaaatagagaggtcaccagttgtttactaccttatggtaaaatgcccggatcaagatccatgtatcccccccatattgtgatgatgcaatcaaagcatagtttttttctactttctgaaatattactgatgaaatcactttacatttaagaggagaaaacagactgccttggattttttttttgtcttgagagaaaaaacaaaatatttagtattgcaagcataaacatttggactcaataaatgacaaattat

SEQ ID NO: 130507 - DNA, 1359 bp, Homo sapiens
  Payload ID: 5526
  Gene Symbol: ERGIC3
  Gene Name: ERGIC and golgi 3
  Uniprot ID: Q9Y282
  ENST ID: ENST00000348547
  CDS Start-End: 78-1229
aggggggcgtggctccaggccggaagagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 130508 - DNA, 1357 bp, Homo sapiens
  Payload ID: 5526
  Gene Symbol: ERGIC3
  Gene Name: ERGIC and golgi 3
  Uniprot ID: Q9Y282
  ENST ID: ENST00000357394
  CDS Start-End: 61-1227
ggccggaagagggagtctgtaggggcgggccggctggcgtcccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtacatgctgtggagatccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagta

SEQ ID NO: 130509 - DNA, 590 bp, Homo sapiens
  Payload ID: 5526
  Gene Symbol: ERGIC3
  Gene Name: ERGIC and golgi 3
  ENST ID: ENST00000438317
  CDS Start-End: 20-391
ccctttccggccggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgattaatgcaggacaccagtggaaccaacataatttgctataggactggatgtggagtggaggagagcaaagtcatggttgttgattccaacgctttcagcctgagcaaatgaatgacttgagatggagatgactggaggagaagagcttgggaaagtcgaggtgacggtgtttgaccctgactccctggaccctgatcgctgtg

SEQ ID NO: 130510 - DNA, 1235 bp, Homo sapiens
  Payload ID: 5526
  Gene Symbol: ERGIC3
  Gene Name: ERGIC and golgi 3
  ENST ID: ENST00000416206
  CDS Start-End: 1-1193
aggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcct

SEQ ID NO: 130511 - DNA, 977 bp, Homo sapiens
  Payload ID: 5526
  Gene Symbol: ERGIC3
  Gene Name: ERGIC and golgi 3
  ENST ID: ENST00000413587
  CDS Start-End: 1-977
tgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctggtcccagtaccttagcctgattttcctgcttccagatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctct

SEQ ID NO: 130512 - DNA, 472 bp, Homo sapiens
  Payload ID: 5526
  Gene Symbol: ERGIC3
  Gene Name: ERGIC and golgi 3
  ENST ID: ENST00000442139
  CDS Start-End: 1-472
cccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggctcaacaggaaaggggaaggagcaggggtggggctgatggtggctggagccaggtcctagccctagccctggcccaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctacca

SEQ ID NO: 130513 - DNA, 601 bp, Homo sapiens
  Payload ID: 5526
  Gene Symbol: ERGIC3
  Gene Name: ERGIC and golgi 3
  ENST ID: ENST00000411577
  CDS Start-End: 1-357
ctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgcagattaatgcaggacaccagtggaaccaacataatttgctataggactggatgtggagtggaggagagcaaagtcatggttgttgattccaacgctttcagcctgagcaaatgaatgacttgagatggagatgactggaggagaaggtttttttggtgggagggaggagtggctattggatatccactgctgtgtaacaaagtactccaaaagttagtagtttgatacaataaaaatgtgttttttcagtt

SEQ ID NO: 130514 - DNA, 520 bp, Homo sapiens
  Payload ID: 5526
  Gene Symbol: ERGIC3
  Gene Name: ERGIC and golgi 3
  ENST ID: ENST00000451605
  CDS Start-End: 1-391
ccccctggaccacaccaatgtcactgcgccccaagcctccatgatgttccagtactttgtgaaggtggtgcccactgtgtacatgaaggtggacggagaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagt

SEQ ID NO: 130515 - DNA, 1479 bp, Homo sapiens
  Payload ID: 5527
  Gene Symbol: ERI2
  Gene Name: ERI1 exoribonuclease family member 2
  Uniprot ID: A8K979
  ENST ID: ENST00000300005
  CDS Start-End: 44-1030
cgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaagggtcccttcctcttgccttcgtggacctggaacagtgatctggcctcaggggaccagcatgcttttcttcagcaagaatttggctgtggaacctacagaaccttacttcagaagcccaatatgagtaaacaggaaaaggggaatattctctggttgacaatggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattca

SEQ ID NO: 130516 - DNA, 3499 bp, Homo sapiens
  Payload ID: 5527
  Gene Symbol: ERI2
  Gene Name: ERI1 exoribonuclease family member 2
  Uniprot ID: A8K979
  ENST ID: ENST00000357967
  CDS Start-End: 44-2119
cgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacatttaaaaattaatcagcaattgatggtattatttttatattaagaaatgataggaacattgacactaatgtggaggaatttgccaaatattttatttcaaaatttagcctctgatatcataaccacaagatattttaaatcaacagtttctaagcatactaccacagtttttatgacctctccatcatcttgtggtttctagagattgacagatactatgtttgttttatagatatggtaattaatgaaacaactttaaattgtcttccattctttcttcctcagttcatttctttttgtcttcccactgatagtctttggcagctcttgaataaattctacctgttggcatcaaggggaagaaaattagcctggaaatttttatctttacataaagccaattatatagcagtttgattatgaattctaggtggaagaattagaatagtctttggaatgggttttgggtaacagccaaaatagggaaaagggtattgttaggaaagttgtcttgatattaagtatttactgtgagtccagtaagccaaaggaccaaacaaaataggttcagggtttcattttaatctcaaagattctgattcttacccatatgtcatcagttcagtttgggacatgtggtgcagcatgtgtgaagaaaatattcattaaaatgtaaaaataaacacttgaaattgtccacaacactgagcaaatattcgttataattaggatgcctacctttctgggatatttgtaaggtgctgtagtttttttaacatgctcctgaatctcctttattagttgttcttgatcatgtgacttgtaatcaggatttagaacgacaaaagcctttactacctaaaataaatatttgaaacaccagg

SEQ ID NO: 130517 - DNA, 2903 bp, Homo sapiens
  Payload ID: 5527
  Gene Symbol: ERI2
  Gene Name: ERI1 exoribonuclease family member 2
  Uniprot ID: A8K979
  ENST ID: ENST00000563117
  CDS Start-End: 757-2553
aacgggcgtctgcctggcaaagaaggaaggtgctgccgagcggcttcgccgcctaaaaccactccccacgccccctagcccgggaaacgcagaagagaagacgggcggggagcagaggttctcccctccttagccacagctgccaacaacaaccgcccctcagcctcgcgggctttttgaacggaccggaagtagaagtcgagcgacttccggcagctggacttggaaaagcaaggagtgtcgggaatggcgaccaagcggctcgcgcgaaagggtacactcgccagcagttttgccaggagagtacactgaacaaaggagacagggtcatttataacgtggcgcgtccaccctactgctgtgtccggtttcctttggctggaacgggacctcacattctgtatttgtcccgactgactagcaacatagaactttttaaaagaggcaaaggcagaggagaacaaaggaagaaggaagtaacttgtggaatgctgagaaaggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttct

SEQ ID NO: 130518 - DNA, 2579 bp, Homo sapiens
  Payload ID: 5527
  Gene Symbol: ERI2
  Gene Name: ERI1 exoribonuclease family member 2
  ENST ID: ENST00000568805
  CDS Start-End: 43-513
gacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagcttttctataggagaaaaccaaaaggactaagtggtgccttgcaggaagtaggaatagaattctcaggacgagaacattctgtgtttgatatctgtatcctcagggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacatttaaaaattaatcagcaattgatggtattatttttatattaag

SEQ ID NO: 130519 - DNA, 3657 bp, Homo sapiens
  Payload ID: 5527
  Gene Symbol: ERI2
  Gene Name: ERI1 exoribonuclease family member 2
  Uniprot ID: A8K979
  ENST ID: ENST00000564349
  CDS Start-End: 477-2273
ggaggcggtggcagtggtggaagaagaggcggcggcggcgggggtagggagcctggaaacgcgagcggggatggtaggtggtttggacccgccgggccgccgtcgtttccagaaagggtttgactggaggaacctctggagcagctgcttttggacaaactcttctgaaaggtgggcaacctagaaagccagttgatgccacttgctattggagttgtgggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaaggttcccactaagaagaatttcagcattctggccagaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacatttaaaaattaatcagcaattgatggtattatttttatattaagaaatgataggaacattgacactaatgtggaggaatttgccaaatattttatttcaaaatttagcctctgatatcataaccacaagatattttaaatcaacagtttctaagcatactaccacagtttttatgacctctccatcatcttgtggtttctagagattgacagatactatgtttgttttatagatatggtaattaatgaaacaactttaaattgtcttccattctttcttcctcagttcatttctttttgtcttcccactgatagtctttggcagctcttgaataaattctacctgttggcatcaaggggaagaaaattagcctggaaatttttatctttacataaagccaattatatagcagtttgattatgaattctaggtggaagaattagaatagtctttggaatgggttttgggtaacagccaaaatagggaaaagggtattgttaggaaagttgtcttgatattaagtatttactgtgagtccagtaagccaaaggaccaaacaaaataggttcagggtttcattttaatctcaaagattctgattcttacccatatgtcatcagttcagtttgggacatgtggtgcagcatgtgtgaagaaaatattcattaaaatgtaaaaataaacacttgaaattgtccacaacactgagcaaatattcgttataattaggatgcctacctttctgggatatttgtaaggtgctgtagtttttttaacatgctcctgaatctcctttattagttgttcttgatcatgtgacttgtaatcaggatttagaacgacaaaagcctttactacctaaaataaatatttgaaacaccaggaaaa

SEQ ID NO: 130520 - DNA, 2646 bp, Homo sapiens
  Payload ID: 5527
  Gene Symbol: ERI2
  Gene Name: ERI1 exoribonuclease family member 2
  Uniprot ID: A8K979
  ENST ID: ENST00000569729
  CDS Start-End: 47-886
gagcgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaagcagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacatttaaaaattaatcagcaattgatggtattatttttatattaagaaatgataggaacattgacactaatgtggaggaatttgccaaatattttatttcaaaatttagcctctgatatcataaccacaagatattttaaatcaacagtttctaagcatactaccacagtttttatgacctctccatcatcttgtggtttctagagattgacagatactatgtttgttttatagatatggtaattaatgaaacaactttaaattgtcttccattctttcttcctcagttcatttctttttgtcttcccactgatagtctttggcagctcttgaataaattctacctgttggcatcaaggggaagaaaattagcctggaaatttttatctttacataaagccaattatatagcagtttgattatgaattctaggtggaagaattagaatagtctttggaatgggttttgggtaacagccaaaatagggaaaagggtattgttaggaaagttgtcttgatattaagtatttactgtgagtccagtaagccaaaggaccaaacaaaataggttcagggtttcattttaatctcaaagattctgattcttacccatatgtcatcagttcagtttgggacatgtggtgcagcatgtgtgaagaaaatattcattaaaatgtaaaaataaacacttgaaattgtccacaacactgagcaaatattcgttataattaggatgcctacctttctgggatatttgtaaggtgctgtagtttttttaacatgctcctgaatctcctttattagttgttcttgatcatgtgacttgtaatcaggatttagaacgacaaaagcctttactacctaaaataaatatttgaaacaccagg

SEQ ID NO: 130521 - DNA, 1684 bp, Homo sapiens
  Payload ID: 5528
  Gene Symbol: ERI3
  Gene Name: ERI1 exoribonuclease family member 3
  Uniprot ID: O43414
  ENST ID: ENST00000372257
  CDS Start-End: 183-1196
ccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagcca

SEQ ID NO: 130522 - DNA, 1332 bp, Homo sapiens
  Payload ID: 5528
  Gene Symbol: ERI3
  Gene Name: ERI1 exoribonuclease family member 3
  Uniprot ID: O43414
  ENST ID: ENST00000372259
  CDS Start-End: 176-844
gaaattggctgagagaaaaggtcagggtcaggaataacagtttcattatctgagcaactggacatagaggctggcacttgggcacattgtcacaaatctttgtgttgggattaatgccactaacctgtagtgttggggttccatctctgatcattatcagctaaaaatcttcaaaatgtttgtcatgcttcaggtgccctggctgcagagttgtgccaacttggtgcagattggggcacctctcccactactgggctgtttgggccagtattttgaggttctgggaagtatggaagtactggctgggcaatatgggatggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagcca

SEQ ID NO: 130523 - DNA, 1103 bp, Homo sapiens
  Payload ID: 5528
  Gene Symbol: ERI3
  Gene Name: ERI1 exoribonuclease family member 3
  ENST ID: ENST00000456170
  CDS Start-End: 1-615
ctccaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaagggcagcagtcctggaacagcctcaggaacctcatgctaccagtcagaggaagctcagagaaaggagaacacaccgggggtcaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagcca

SEQ ID NO: 130524 - DNA, 764 bp, Homo sapiens
  Payload ID: 5528
  Gene Symbol: ERI3
  Gene Name: ERI1 exoribonuclease family member 3
  ENST ID: ENST00000452396
  CDS Start-End: 235-764
ggtgagtcggtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccggggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaa

SEQ ID NO: 130525 - DNA, 975 bp, Homo sapiens
  Payload ID: 5528
  Gene Symbol: ERI3
  Gene Name: ERI1 exoribonuclease family member 3
  ENST ID: ENST00000457571
  CDS Start-End: 224-975
gtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcat

SEQ ID NO: 130526 - DNA, 3760 bp, Homo sapiens
  Payload ID: 5529
  Gene Symbol: ERMN
  Gene Name: ermin, ERM-like protein
  Uniprot ID: Q8TAM6
  ENST ID: ENST00000397283
  CDS Start-End: 235-1128
cacaactgtctctactgccaaggtgctaatgccgaacccctgtgggatctctggtccaaggaaacatctgcacacaggccagggatggcgcttagcttcatctgtgctgcaaactctcatcagtaggcttgctggctctgtgaccttactagctgaactccttaatctctctgcacttcatttttctagtctataaaatggagataacaacagcacctacctcagaagactgttatgaagactctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgactt

SEQ ID NO: 130527 - DNA, 3793 bp, Homo sapiens
  Payload ID: 5529
  Gene Symbol: ERMN
  Gene Name: ermin, ERM-like protein
  Uniprot ID: Q8TAM6
  ENST ID: ENST00000410096
  CDS Start-End: 293-1147
gatgcctttaactctgccagggaactggcaagcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaag

SEQ ID NO: 130528 - DNA, 746 bp, Homo sapiens
  Payload ID: 5529
  Gene Symbol: ERMN
  Gene Name: ermin, ERM-like protein
  ENST ID: ENST00000409216
  CDS Start-End: 183-623
aatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagacggagtgtcactcttgttgcccaggctggagtgcaatggtgcaatctcggcagactgcaacctctgtctccagggttcaagcgattctcctgcctcagcttcctgagtaactgggattacagggcatcagtgggagaagattcctctgagtggcagtaaccaggaaataagaagacagaaggagaggattactgagcagcctctcaaagaggaagaagatgaggacagg

SEQ ID NO: 130529 - DNA, 556 bp, Homo sapiens
  Payload ID: 5529
  Gene Symbol: ERMN
  Gene Name: ermin, ERM-like protein
  ENST ID: ENST00000409925
  CDS Start-End: 18-458
ggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagacggagtgtcactcttgttgcccaggctggagtgcaatggtgcaatctcggcagactgcaacctctgtctccagggttcaagcgattctcctgcctcagcttcctgagtaactgggattacaggcacctgacaccacgcccagctattttgtggcatcagtgggagaagattcctctgagtggcagtaaccaggaaataagaaga

SEQ ID NO: 130530 - DNA, 1466 bp, Homo sapiens
  Payload ID: 5529
  Gene Symbol: ERMN
  Gene Name: ermin, ERM-like protein
  ENST ID: ENST00000409395
  CDS Start-End: 232-486
cttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaaggctggtctatttgacagctgtgaccccagacaactttctgtctcccgaagcctgagtttttttcactagaagaaggcggaataataataataactacaagtctaggaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccct

SEQ ID NO: 130531 - DNA, 590 bp, Homo sapiens
  Payload ID: 5529
  Gene Symbol: ERMN
  Gene Name: ermin, ERM-like protein
  ENST ID: ENST00000411762
  CDS Start-End: 134-590
agagatgtcttccaaggacaagggagaggggattatacaagagtgaggtgttgtccctgatatagacctgaatgggctcagccctagacacacttttaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcacc

SEQ ID NO: 130532 - DNA, 541 bp, Homo sapiens
  Payload ID: 5529
  Gene Symbol: ERMN
  Gene Name: ermin, ERM-like protein
  ENST ID: ENST00000420317
  CDS Start-End: 61-541
atagacctgaatgggctcagccctagacacacttttaaagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgg

SEQ ID NO: 130533 - DNA, 1246 bp, Homo sapiens
  Payload ID: 5529
  Gene Symbol: ERMN
  Gene Name: ermin, ERM-like protein
  ENST ID: ENST00000420719
  CDS Start-End: 183-977
aatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagt

SEQ ID NO: 130534 - DNA, 594 bp, Homo sapiens
  Payload ID: 5529
  Gene Symbol: ERMN
  Gene Name: ermin, ERM-like protein
  ENST ID: ENST00000419116
  CDS Start-End: 260-594
aacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaagagaaactctttattgttcataaggctatcacagatctttctctccaagaaactagtgctgatgaaatgacattcagagaagggcatcagtg

SEQ ID NO: 130535 - DNA, 3949 bp, Homo sapiens
  Payload ID: 5530
  Gene Symbol: ERMAP
  Gene Name: erythroblast membrane-associated protein (Scianna blood group)
  ENST ID: ENST00000328249
  CDS Start-End: 1039-2196
ggagggacctcactgccttgatctgttatttatcaagagtcaaactggaaaaggctgtcagggaaacctccaggctgcatcttgggcaaagattggcttgaaacaggcatttcccaagcctggccttggacaccaactgtaaaaaaaaggccattactggtgtttccttggttagttctgggtataagttctggatcctcactcatctcatctgcactgacatcctcactcacggcatttagagacttaacacgccagcctctgtgtgagcatttacctctttcaaccctcaccataatcccacaaggaggcacagttcttttacccattttgaagatgaagaaacacagtctcagagaagttcggtcacagtatcacaaggaggtaagtagcagagctgggattggagccccggcctttgtgatcccagagcaccagcaataccgtctcggcctcggctcctgggttataccctctgtcacgccaagcccatcagcccgcttgtgctgtctccctctgtctgtcctagttcggatggagatggcgagttctgctggctcctggctctctggctgcctcatccctctcgtcttcctccggctgtctgtgcatgtgtcaggtaggagtttctgatcctctttccctgcctggtacatgtgatattggcgtccccagaataaggaagcttggctggaaacattatgtcttttggggttctgttcccccggccctggcaatcctttccagagtccttcctgggctctgtccgtccccgggatatcctcttcctcatcccttcccaagctttctcctgccgtccctcccagttggccttgtctctttttttgtccaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtg

SEQ ID NO: 130536 - DNA, 3369 bp, Homo sapiens
  Payload ID: 5530
  Gene Symbol: ERMAP
  Gene Name: erythroblast membrane-associated protein (Scianna blood group)
  Uniprot ID: Q96PL5
  ENST ID: ENST00000372514
  CDS Start-End: 185-1612
cagagagagccctggcctctcatatttcataaaatatgaacttttcccggcccacatccctaggccttcctgatgcgcttgcctgctccctggtctctctgcatggggaaggagtgttcccagcttgcaaactccagctttgcctgtgagaggaacaagcgtccctgatccagaaggtgttcggatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtgtttt

SEQ ID NO: 130537 - DNA, 3423 bp, Homo sapiens
  Payload ID: 5530
  Gene Symbol: ERMAP
  Gene Name: erythroblast membrane-associated protein (Scianna blood group)
  Uniprot ID: Q96PL5
  ENST ID: ENST00000372517
  CDS Start-End: 245-1672
ctcctggaggaaaatggcggtcgctggagccgccgaccaagaggcttgggagtctgtacctttcccgaccgggccactggaagttggagcctccgccgagtcgcagacaacgcctccgggagggccttcctgatgcgcttgcctgctccctggtctctctgcatggggaaggagtgttcccagcttgcaaactccagctttgcctgtgagaggaacaagcgtccctgatccagaaggtgttcggatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttg

SEQ ID NO: 130538 - DNA, 2676 bp, Homo sapiens
  Payload ID: 5531
  Gene Symbol: EPB41
  Gene Name: erythrocyte membrane protein band 4.1
  Uniprot ID: P11171
  ENST ID: ENST00000347529
  CDS Start-End: 47-2374
agaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctag

SEQ ID NO: 130539 - DNA, 3029 bp, Homo sapiens
  Payload ID: 5531
  Gene Symbol: EPB41
  Gene Name: erythrocyte membrane protein band 4.1
  Uniprot ID: P11171
  ENST ID: ENST00000349460
  CDS Start-End: 802-2727
ggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattattttcagagtcttcttatttctgaagcatgtgaatattatctgcatcgttaaaagtcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctag

SEQ ID NO: 130540 - DNA, 5956 bp, Homo sapiens
  Payload ID: 5531
  Gene Symbol: EPB41
  Gene Name: erythrocyte membrane protein band 4.1
  Uniprot ID: P11171
  ENST ID: ENST00000343067
  CDS Start-End: 128-2722
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctc

SEQ ID NO: 130541 - DNA, 5857 bp, Homo sapiens
  Payload ID: 5531
  Gene Symbol: EPB41
  Gene Name: erythrocyte membrane protein band 4.1
  ENST ID: ENST00000356093
  CDS Start-End: 755-2623
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctc

SEQ ID NO: 130542 - DNA, 2402 bp, Homo sapiens
  Payload ID: 5531
  Gene Symbol: EPB41
  Gene Name: erythrocyte membrane protein band 4.1
  Uniprot ID: P11171
  ENST ID: ENST00000373797
  CDS Start-End: 198-2360
cgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggagtgagtactttgtccacatgaccaattgtgaaaatggagggaataaatgtttttatgtattaa

SEQ ID NO: 130543 - DNA, 5933 bp, Homo sapiens
  Payload ID: 5531
  Gene Symbol: EPB41
  Gene Name: erythrocyte membrane protein band 4.1
  Uniprot ID: P11171
  ENST ID: ENST00000373798
  CDS Start-End: 105-2699
tgtgtctcactgctgtcatttgcttccatgtgccactgcggtgatggctccatggcctctcctggactggctgcgtgaccccgacggctgcttctggcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctc

SEQ ID NO: 130544 - DNA, 2853 bp, Homo sapiens
  Payload ID: 5531
  Gene Symbol: EPB41
  Gene Name: erythrocyte membrane protein band 4.1
  Uniprot ID: P11171
  ENST ID: ENST00000373800
  CDS Start-End: 785-2551
ggggcaaagtggcaggaacctcttaaagggcgagagcggcgcggagccagaacgcggtcggcccggtccccgccgcacccagcccagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattattttcagagtcttcttatttctgaagcatgtgaatattatctgcatcgttaaaagtcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctag

SEQ ID NO: 130545 - DNA, 4707 bp, Homo sapiens
  Payload ID: 5532
  Gene Symbol: EPB41L4A
  Gene Name: erythrocyte membrane protein band 4.1 like 4A
  Uniprot ID: Q9HCS5
  ENST ID: ENST00000261486
  CDS Start-End: 278-2338
cgcaggatgcgcggggacgcgccaccgccctccgcgcccagttccgccggcgcttccccggcggctcccgggcgctgactctcccgggcttttccgcctttctcgctcccgccccgccgggcggttcggcggccggtccccggaccccgccgggagctgctcgtctcaccctcgccacggcgcggacaataaattaatgcatcgcgcttgagtggagggggcggctgggcgcctcggtggtagctttctctcctggctggagacgaccacaaccgacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacagcatcagtaggataactgcaaacatggaaaatggagaaaatgaaggaacaattaaaattattgcaccttcaccagtaaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaataccggaaaaagagaaacagaatacggcaggagaatgatatggttgattcagcgcctcagtgggaagctgtattaaggagacaaaaggaaaaaaaccaagccgaccccaacaacaggcgatccagacacagatctcgttcgagaagccccgatatccaagcaaaagaagagttatggaagcacattcaaaaagaacttgtggatccatccggattgtccgaagaacaattaaaagagattccatacactaaaatagagacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccgttcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagagacttgatcctgatgaagggtcaagggtaggggtgggaaggttgtgtgcgccactggtacttttgaaactgtgaaataggtatcttaattcaaatctcagacctgcaagtatttcttcagcatgagaaaatacattatcttttgcttctttttttttttttttttgagatgttatcactctgtcgcccaggctggagtgcagcggcaccgtgtcagctcaccgcagcctccacttactgggttaagcgattctcctgtctcaggctcccgagcagctgggattacaggcgtgcaccacaacacccggctaattctttttgtatttttagtagagacagggctttgccatgttggaggctggtctcgaactcctgacctcaagtgatccgcctgcctcagcctcccaaagtgctgggattataggccatggtttaactacagcacagttgtgctgaaggacctttttgttttaactggaagaataagtattttgtaaaaattcacttgataccacattttcatttctggaacaggatagcaatcattcatttctatcttgtgtctgtgtccaccacaaccaagaccagatgcatctgatgaacattctggaattctgaactgcagctagcctgctgtgcaatagtacaagtgggaggacgtcttcccagggctgggctggttctcaactagtgcccagatgcaaaaggactgaggcatcactttcagactgcatatatttttattcatataaagttctttataatactttattttgtggtgttaagttccaccagttatttacaaatgatgtaaaaagctttaagtgttgttaatttctaaagtgttcttgcgttttcagaagtgtaagtggatctcagttgatctgtcaccccaaacctcaaatgatccatccaccctgcttggccatctaattcacctgctctccccagtgactattttgtacctttcctctccatagatgactttgcaatctacagggaaaatacttatgcaggacatcttatatctcccccttaccacgtacagttctctccacagctgccagcagccctaacctttttgtctctccacctgtgctttggatgctcttctcccagccttttcaggatctttgtctgtcctcctatattaatgtattcaattattctctcagctagatccttgctacttggttttaaatttaagactaagattaaacaaaactatctttcacaaccacaaaccccctcccgccaagcaactaagattttcctctcattctcagccagttttcttgcaagcagtatctttagtcattgccctcaattcatctaatccctatcttaagctatctctaacatggatctttccctctactccactaatatcaatcactgtgttacttaatcccagggagaatttttaggacattcttttgcttctttaatataatcctattttgctcctaccactgaccatcctttctggcttatcatgctttaccttgccattaattagtggagtttctcaaacttcagaccctaggccctcttcctctaccaccagcagatctcatttatacccatggccttaaggtttatttctgtagtttagactactgagtaatgtgctactgcaaaaagaccatttgggtttctcaaaggtaatttaaaaattcagctgtttaaatgctgctccccagctgaatctagggtcattatgctcatcagtgtgcaagctggacacctagcagttatggacacctccactattaccacgtctagttggctctgtcatccaactataaacgatcttatttcactaattttactagtccaagctggtctcttgtctagacaacaataagcaacctagttcaactaccttttcttgcaaatctgattttccaccatggatttatcttgctttaataaagccagagggagcctgaagtggtctggcttctttacctacctcttcagcctcattttgtaacactctcacctcccataatagccatcttacaagcctcagtaaggactcagttctaaaacagggcactgaagagggaaagcagccaaaactgtctcaaaagtaagtggactaacggtatcttttttctagcccaagcctctgtatatgtcattcccccagttttgccttgtgaaaaatatgacacatacctttagtctcaactctttctcaggtttccctaagaaaatcctatcacggaactcatctcatagtgaagttttacatttgtgatgacattccctccacttatctatgtttccaaagggaagaactgtgttgtgctcatcatcgtgttctcagctcctagtacagtgctttcaataaattttttgaatacctcta

SEQ ID NO: 130546 - DNA, 4707 bp, Homo sapiens
  Payload ID: 5532
  Gene Symbol: EPB41L4A
  Gene Name: erythrocyte membrane protein band 4.1 like 4A
  Uniprot ID: Q9HCS5
  ENST ID: ENST00000621003
  CDS Start-End: 275-2335
aggatgcgcggggacgcgccaccgccctccgcgcccagttccgccggcgcttccccggcggctcccgggcgctgactctcccgggcttttccgcctttctcgctcccgccccgccgggcggttcggcggccggtccccggaccccgccgggagctgctcgtctcaccctcgccacggcgcggacaataaattaatgcatcgcgcttgagtggagggggcggctgggcgcctcggtggtagctttctctcctggctggagacgaccacaaccgacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacagcatcagtaggataactgcaaacatggaaaatggagaaaatgaaggaacaattaaaattattgcaccttcaccagtaaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaataccggaaaaagagaaacagaatacggcaggagaatgatatggttgattcagcgcctcagtgggaagctgtattaaggagacaaaaggaaaaaaaccaagccgaccccaacaacaggcgatccagacacagatctcgttcgagaagccccgatatccaagcaaaagaagagttatggaagcacattcaaaaagaacttgtggatccatccggattgtccgaagaacaattaaaagagattccatacactaaaatagagacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccgttcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagagacttgatcctgatgaagggtcaagggtaggggtgggaaggttgtgtgcgccactggtacttttgaaactgtgaaataggtatcttaattcaaatctcagacctgcaagtatttcttcagcatgagaaaatacattatcttttgcttctttttttttttttttttgagatgttatcactctgtcgcccaggctggagtgcagcggcaccgtgtcagctcaccgcagcctccacttactgggttaagcgattctcctgtctcaggctcccgagcagctgggattacaggcgtgcaccacaacacccggctaattctttttgtatttttagtagagacagggctttgccatgttggaggctggtctcgaactcctgacctcaagtgatccgcctgcctcagcctcccaaagtgctgggattataggccatggtttaactacagcacagttgtgctgaaggacctttttgttttaactggaagaataagtattttgtaaaaattcacttgataccacattttcatttctggaacaggatagcaatcattcatttctatcttgtgtctgtgtccaccacaaccaagaccagatgcatctgatgaacattctggaattctgaactgcagctagcctgctgtgcaatagtacaagtgggaggacgtcttcccagggctgggctggttctcaactagtgcccagatgcaaaaggactgaggcatcactttcagactgcatatatttttattcatataaagttctttataatactttattttgtggtgttaagttccaccagttatttacaaatgatgtaaaaagctttaagtgttgttaatttctaaagtgttcttgcgttttcagaagtgtaagtggatctcagttgatctgtcaccccaaacctcaaatgatccatccaccctgcttggccatctaattcacctgctctccccagtgactattttgtacctttcctctccatagatgactttgcaatctacagggaaaatacttatgcaggacatcttatatctcccccttaccacgtacagttctctccacagctgccagcagccctaacctttttgtctctccacctgtgctttggatgctcttctcccagccttttcaggatctttgtctgtcctcctatattaatgtattcaattattctctcagctagatccttgctacttggttttaaatttaagactaagattaaacaaaactatctttcacaaccacaaaccccctcccgccaagcaactaagattttcctctcattctcagccagttttcttgcaagcagtatctttagtcattgccctcaattcatctaatccctatcttaagctatctctaacatggatctttccctctactccactaatatcaatcactgtgttacttaatcccagggagaatttttaggacattcttttgcttctttaatataatcctattttgctcctaccactgaccatcctttctggcttatcatgctttaccttgccattaattagtggagtttctcaaacttcagaccctaggccctcttcctctaccaccagcagatctcatttatacccatggccttaaggtttatttctgtagtttagactactgagtaatgtgctactgcaaaaagaccatttgggtttctcaaaggtaatttaaaaattcagctgtttaaatgctgctccccagctgaatctagggtcattatgctcatcagtgtgcaagctggacacctagcagttatggacacctccactattaccacgtctagttggctctgtcatccaactataaacgatcttatttcactaattttactagtccaagctggtctcttgtctagacaacaataagcaacctagttcaactaccttttcttgcaaatctgattttccaccatggatttatcttgctttaataaagccagagggagcctgaagtggtctggcttctttacctacctcttcagcctcattttgtaacactctcacctcccataatagccatcttacaagcctcagtaaggactcagttctaaaacagggcactgaagagggaaagcagccaaaactgtctcaaaagtaagtggactaacggtatcttttttctagcccaagcctctgtatatgtcattcccccagttttgccttgtgaaaaatatgacacatacctttagtctcaactctttctcaggtttccctaagaaaatcctatcacggaactcatctcatagtgaagttttacatttgtgatgacattccctccacttatctatgtttccaaagggaagaactgtgttgtgctcatcatcgtgttctcagctcctagtacagtgctttcaataaattttttgaatacctctatac

SEQ ID NO: 130547 - DNA, 4006 bp, Homo sapiens
  Payload ID: 5533
  Gene Symbol: EPB41L4B
  Gene Name: erythrocyte membrane protein band 4.1 like 4B
  Uniprot ID: Q9H329
  ENST ID: ENST00000374557
  CDS Start-End: 519-2075
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaa

SEQ ID NO: 130548 - DNA, 5800 bp, Homo sapiens
  Payload ID: 5533
  Gene Symbol: EPB41L4B
  Gene Name: erythrocyte membrane protein band 4.1 like 4B
  Uniprot ID: Q9H329
  ENST ID: ENST00000374566
  CDS Start-End: 519-3221
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgagtgaggaagttaacaagacagtatagttttgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaacccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccacccggaaacctgtttctctggcagccagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaagattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttc

SEQ ID NO: 130549 - DNA, 6628 bp, Homo sapiens
  Payload ID: 5534
  Gene Symbol: EPB41L5
  Gene Name: erythrocyte membrane protein band 4.1 like 5
  Uniprot ID: Q9HCM4
  ENST ID: ENST00000263713
  CDS Start-End: 215-2416
aagagcggagcgctccgccctgggggcggagctgggagggagctttaaggggtggacgggcgggaggtcggggtcctccggggattagagccggtgggctcgttgtgggcgccatttctcggcgtctaccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaagcaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgcagagtggtgccatgtctaatggacttgcgggatgtgaaatgcttttgacagggaaggagggacatggtaataaagatggaatctcactgatctctcccccagcgccattcttggtagatgctgtgaccagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatagtgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattca

SEQ ID NO: 130550 - DNA, 1777 bp, Homo sapiens
  Payload ID: 5534
  Gene Symbol: EPB41L5
  Gene Name: erythrocyte membrane protein band 4.1 like 5
  Uniprot ID: Q9HCM4
  ENST ID: ENST00000331393
  CDS Start-End: 101-1618
tttctcggcgtctaccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatggctctctgctgccagcgactgctgtcaacgtggtggaaaccagtggaacacaagggccttgcccccaccccagaccgcacatagaaactacactgactttgttcatgagcacaatgtgaagaatgcaggaatccgtcatgatgttcattttcctggccatacagccatgactgagatatgagtgttgagcctcttaggctttgggactctttgtcatgcaagttgatggtatacattatctggtgtttataaaggattaatcacattaggagtatttgggagaatttacagtgagtcactagttgttcagtgctgtttgtaattgaattcttccatgaaa

SEQ ID NO: 130551 - DNA, 6410 bp, Homo sapiens
  Payload ID: 5534
  Gene Symbol: EPB41L5
  Gene Name: erythrocyte membrane protein band 4.1 like 5
  Uniprot ID: Q9HCM4
  ENST ID: ENST00000452780
  CDS Start-End: 1-2199
atgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaagcaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgagtggtgccatgtctaatggacttgcgggatgtgaaatgcttttgacagggaaggagggacatggtaataaagatggaatctcactgatctctcccccagcgccattcttggtagatgctgtgaccagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatagtgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattc

SEQ ID NO: 130552 - DNA, 2872 bp, Homo sapiens
  Payload ID: 5534
  Gene Symbol: EPB41L5
  Gene Name: erythrocyte membrane protein band 4.1 like 5
  Uniprot ID: Q9HCM4
  ENST ID: ENST00000443124
  CDS Start-End: 480-1997
gtaagcgcgaggcccggcggcggcgccgcagtacagtccgctgcgctcctagccgagtggacccttcctcgcccgcgcctgcggtagcggccttgtccccggggaggcgggcgggggccgcacccagaccctagggcggccggcccctctctcgtcgggccggcagggcattaatcccgccggagggaggggcggcggcggccaatgaggcagggccgccgagtttcggtcgataccgcgcgacgggccggggcggagggcccggggcagccgggttaatgtttgccgagcggacgcgctccccgagccgcgggtacccctcgctggtccgctgggctgccgtccagcgggagagacaaaagtcgcaagggaaggggaaaaacgaactgagtttgtgtcactgtcttggtggacttttcgagctaacctgtatttgagaaaaacttcagtctcttgggaaaggagaggcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatggctctctgctgccagcgactgctgtcaacgtggtggaaaccagtggaacacaagggccttgcccccaccccagaccgcacatagaaactacactgactttgttcatgagcacaatgtgaagaatgcaggaatccgtcatgatgttcattttcctggccatacagccatgactgagatatgagtgttgagcctcttaggctttgggactctttgtcatgcaagttgatggtatacattatctggtgtttataaaggattaatcacattaggagtatttgggagaatttacagtgagtcactagttgttcagtgctgtttgtaattgaattcttccatgaaagggacaaggaatcaaggaagccatatagcatcaatgataatgacaaatgtttgtgttgaaaagagtgtgtataccattgtggttttggaagagttttcagaccttagtatgttcacacatcaccagactgtatctcaggagaaggtttgtgtttgtgaacaaggtgcccattattcccccaccacatgccatccaaagagatcgaggttaaaagaatcagacacactaaaaacacagtggaagcatgtctaggcataatatatcagccttttgagatatttattaaaaacttgttcttatacactattttaatatgtctaaagtgacacataccttaatttaagtgcctaagattttaattaatataatttttaattacaaacacttttactttttaataaacacgaatattttaacttaccaaaagatttagagatcacattaataatgtggctcatgtatagagaaatctgaatggttagttttgaatggttaactgattaacattcagttatcataacagttaaccagtggttaactgaatggttacattactactgaatggttctataaaatgaaaaacatatttactttgtcttttcatttgactggcttttctctttcatctcatacacctgacagattacccaggtttgcaacagtctcataatctgatcctgtataacctttaaaataaaattctgaagccaaaacca

SEQ ID NO: 130553 - DNA, 3167 bp, Homo sapiens
  Payload ID: 5534
  Gene Symbol: EPB41L5
  Gene Name: erythrocyte membrane protein band 4.1 like 5
  Uniprot ID: Q9HCM4
  ENST ID: ENST00000443902
  CDS Start-End: 143-2206
gtcctccggggattagagccggtgggctcgttgtgggcgccatttctcggcgtctaccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaagcaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactgg

SEQ ID NO: 130554 - DNA, 3514 bp, Homo sapiens
  Payload ID: 5535
  Gene Symbol: EPB41L1
  Gene Name: erythrocyte membrane protein band 4.1-like 1
  Uniprot ID: Q9H4G0
  ENST ID: ENST00000202028
  CDS Start-End: 174-2513
cagaattgttgggcttcatcttggctctgtgctgcctggaggggagacctaggataggctcctgatctgcaaaatggggataatcccagctgccacttaagtgagacaagtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctga

SEQ ID NO: 130555 - DNA, 6266 bp, Homo sapiens
  Payload ID: 5535
  Gene Symbol: EPB41L1
  Gene Name: erythrocyte membrane protein band 4.1-like 1
  Uniprot ID: Q9H4G0
  ENST ID: ENST00000338074
  CDS Start-End: 162-2807
catcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 130556 - DNA, 2652 bp, Homo sapiens
  Payload ID: 5535
  Gene Symbol: EPB41L1
  Gene Name: erythrocyte membrane protein band 4.1-like 1
  ENST ID: ENST00000373941
  CDS Start-End: 10-2652
ctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 130557 - DNA, 763 bp, Homo sapiens
  Payload ID: 5535
  Gene Symbol: EPB41L1
  Gene Name: erythrocyte membrane protein band 4.1-like 1
  ENST ID: ENST00000373945
  CDS Start-End: 165-763
tcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatag

SEQ ID NO: 130558 - DNA, 6327 bp, Homo sapiens
  Payload ID: 5535
  Gene Symbol: EPB41L1
  Gene Name: erythrocyte membrane protein band 4.1-like 1
  ENST ID: ENST00000373946
  CDS Start-End: 226-2868
gcatttctgcgcagctctagcgcgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 130559 - DNA, 3631 bp, Homo sapiens
  Payload ID: 5535
  Gene Symbol: EPB41L1
  Gene Name: erythrocyte membrane protein band 4.1-like 1
  Uniprot ID: Q9H4G0
  ENST ID: ENST00000373950
  CDS Start-End: 326-2644
gcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggaggggccctggaagtgaccactgggctgagtagctcatcagcttccccacactgaagcccgaggggtctcctgctggcttctgagagctgacggaacaggttccagcaaggcagaccctgacacagaagccagacctgtccagcagggaccccatacactgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggt

SEQ ID NO: 130560 - DNA, 652 bp, Homo sapiens
  Payload ID: 5535
  Gene Symbol: EPB41L1
  Gene Name: erythrocyte membrane protein band 4.1-like 1
  ENST ID: ENST00000406771
  CDS Start-End: 149-652
agagcaggagcgagcgcgcgagagagcggggcatttctgcgcagctctagcgcgcctcggagcccgccggggcagccgccggacaccaggaccgcgagccagacagctcccggaagccgcgccgccgccgccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 130561 - DNA, 593 bp, Homo sapiens
  Payload ID: 5535
  Gene Symbol: EPB41L1
  Gene Name: erythrocyte membrane protein band 4.1-like 1
  ENST ID: ENST00000454226
  CDS Start-End: 1-593
gtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcga

SEQ ID NO: 130562 - DNA, 864 bp, Homo sapiens
  Payload ID: 5535
  Gene Symbol: EPB41L1
  Gene Name: erythrocyte membrane protein band 4.1-like 1
  ENST ID: ENST00000432603
  CDS Start-End: 1-359
cctcagtggggagggagttcatagcaaccactccctccatcaccacggagaccatatcgaccaccatgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgc

SEQ ID NO: 130563 - DNA, 210 bp, Homo sapiens
  Payload ID: 5535
  Gene Symbol: EPB41L1
  Gene Name: erythrocyte membrane protein band 4.1-like 1
  ENST ID: ENST00000432589
  CDS Start-End: 99-210
ctttcagatgctatcttgggctcgctgaacacgggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgcc

SEQ ID NO: 130564 - DNA, 896 bp, Homo sapiens
  Payload ID: 5535
  Gene Symbol: EPB41L1
  Gene Name: erythrocyte membrane protein band 4.1-like 1
  ENST ID: ENST00000447825
  CDS Start-End: 555-896
tccgcgtcccggggaccccgccgcgtcgggtcccgcgtgtgcgtgtggggtggccgccgagggcggcgggctcgattcccgatctttgggcactgacaggccggcgggccggctccaggagccgcgggcttcggtagctccttggatattcctttctgcaagtgatcaggcaaagataaattccattttacagatgaggaagctgaggcctgtgaagggaaagtgacctggctacacagccggaacctgaatgcaggacattctgcccctgtcgtggtggtattggagccagctaatgccaccattcgaggttgcaggagcagcacctgaccagaaatccagagcttgtttaaaggaccctgaaatttgaagactatccacacatatctactttctggatatccacggagagaccatgggctttttcatcaaggaggcctgagttcaaatccttcttctatgtctgattctctctgtgaccttgggtgcctgactgacagaagttcttgcccccggggagctggtgtggacagaggaggggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 130565 - DNA, 5967 bp, Homo sapiens
  Payload ID: 5535
  Gene Symbol: EPB41L1
  Gene Name: erythrocyte membrane protein band 4.1-like 1
  Uniprot ID: Q9H4G0
  ENST ID: ENST00000441639
  CDS Start-End: 169-2508
gcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 130566 - DNA, 896 bp, Homo sapiens
  Payload ID: 5535
  Gene Symbol: EPB41L1
  Gene Name: erythrocyte membrane protein band 4.1-like 1
  ENST ID: ENST00000430276
  CDS Start-End: 126-896
cgagagagcggggcatttctgcgcagctctagcgcgcctcggagcccgccggggcagccgccggacaccaggaccgcgagccagacagctcccggaagccgcgccgccgccgccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgcttt

SEQ ID NO: 130567 - DNA, 803 bp, Homo sapiens
  Payload ID: 5535
  Gene Symbol: EPB41L1
  Gene Name: erythrocyte membrane protein band 4.1-like 1
  ENST ID: ENST00000451082
  CDS Start-End: 1-803
aacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccag

SEQ ID NO: 130568 - DNA, 460 bp, Homo sapiens
  Payload ID: 5535
  Gene Symbol: EPB41L1
  Gene Name: erythrocyte membrane protein band 4.1-like 1
  ENST ID: ENST00000427533
  CDS Start-End: 284-460
tctcctgctggcttctgagagctgacggaacaggttccagcaaggcagaccctgacacagaagccagacctgtccagcagggaccccatacactgggaggcttcctgggaaactggaaggcagaagccacgcagacttctagtcctggttccactgcttactcggctgctgttcgtacctgcctcatggttttcttggggaggatcaatgaggtagaacctgcaaagggcttagcagagagcctagcacctactgagcgctcagtaaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacag

SEQ ID NO: 130569 - DNA, 769 bp, Homo sapiens
  Payload ID: 5535
  Gene Symbol: EPB41L1
  Gene Name: erythrocyte membrane protein band 4.1-like 1
  ENST ID: ENST00000452261
  CDS Start-End: 204-769
cgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 130570 - DNA, 3287 bp, Homo sapiens
  Payload ID: 5535
  Gene Symbol: EPB41L1
  Gene Name: erythrocyte membrane protein band 4.1-like 1
  Uniprot ID: Q9H4G0
  ENST ID: ENST00000628415
  CDS Start-End: 179-2284
atttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggaggggctgctgttcgtacctgcctcatggttttcttggggaggatcaatgaggtagaacctgcaaagggcttagcagagagcctagcacctactgagcgctcagtaaagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgaca

SEQ ID NO: 130571 - DNA, 4457 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000337057
  CDS Start-End: 183-3200
gtcgcgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 130572 - DNA, 4456 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000368128
  CDS Start-End: 192-3209
cgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaaaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattct

SEQ ID NO: 130573 - DNA, 3369 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000392427
  CDS Start-End: 94-2115
agcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 130574 - DNA, 1138 bp, Homo sapiens
  Payload ID: 5536
  Gene Symbol: EPB41L2
  Gene Name: erythrocyte membrane protein band 4.1-like 2
  ENST ID: ENST00000456097
  CDS Start-End: 1-1138
cttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagaaaaggagaccatcttttcaaggatattttatccgtgaaggagaagtacctgatgccgacaatatggacagttgaagaaaaagctcaggagacggacaagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagac

SEQ ID NO: 130575 - DNA, 3677 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000445890
  CDS Start-End: 177-2420
ccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 130576 - DNA, 2436 bp, Homo sapiens
  Payload ID: 5536
  Gene Symbol: EPB41L2
  Gene Name: erythrocyte membrane protein band 4.1-like 2
  ENST ID: ENST00000527659
  CDS Start-End: 1-2436
atgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaa

SEQ ID NO: 130577 - DNA, 2121 bp, Homo sapiens
  Payload ID: 5536
  Gene Symbol: EPB41L2
  Gene Name: erythrocyte membrane protein band 4.1-like 2
  ENST ID: ENST00000525193
  CDS Start-End: 1-2121
atgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaa

SEQ ID NO: 130578 - DNA, 591 bp, Homo sapiens
  Payload ID: 5536
  Gene Symbol: EPB41L2
  Gene Name: erythrocyte membrane protein band 4.1-like 2
  ENST ID: ENST00000532499
  CDS Start-End: 104-591
gaacttcggcttcatcctgtgacttgctcagatgtctttatgtgatccatagtattgtagaaaaacctcagattcaaatgaaagatatgcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagat

SEQ ID NO: 130579 - DNA, 552 bp, Homo sapiens
  Payload ID: 5536
  Gene Symbol: EPB41L2
  Gene Name: erythrocyte membrane protein band 4.1-like 2
  ENST ID: ENST00000526983
  CDS Start-End: 92-552
gatgcagacatagcctatttggcagctattttatgatagtggtgaacagcacacaaaactccttcagaccctcccaacataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaaga

SEQ ID NO: 130580 - DNA, 2568 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000525271
  CDS Start-End: 125-2146
aatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgact

SEQ ID NO: 130581 - DNA, 727 bp, Homo sapiens
  Payload ID: 5536
  Gene Symbol: EPB41L2
  Gene Name: erythrocyte membrane protein band 4.1-like 2
  ENST ID: ENST00000527017
  CDS Start-End: 7-727
gcgaagatggaagaagaggaaacgcagctggaagaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgagacacgtgctcccgagtcagaagggccttgcactggagccagggatgctgttaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatca

SEQ ID NO: 130582 - DNA, 3663 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000528282
  CDS Start-End: 163-2406
actgtacttaaggcgtttatcctaatccaggcgtccttggattgcacggtgccagcaagcaaggtggtaacagtgatcacagcctgggctgcaggtgtgagttctgaggagatctatggtttacccagcgaatttattactgataaatcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 130583 - DNA, 3914 bp, Homo sapiens
  Payload ID: 5536
  Gene Symbol: EPB41L2
  Gene Name: erythrocyte membrane protein band 4.1-like 2
  Uniprot ID: O43491
  ENST ID: ENST00000530481
  CDS Start-End: 99-2657
gaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 130584 - DNA, 2926 bp, Homo sapiens
  Payload ID: 5536
  Gene Symbol: EPB41L2
  Gene Name: erythrocyte membrane protein band 4.1-like 2
  ENST ID: ENST00000531410
  CDS Start-End: 1289-1669
taaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagagaaaaattccttgagagtagaaggggataatatttatgtcagacatagcaatttaatgttggagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 130585 - DNA, 981 bp, Homo sapiens
  Payload ID: 5536
  Gene Symbol: EPB41L2
  Gene Name: erythrocyte membrane protein band 4.1-like 2
  ENST ID: ENST00000525198
  CDS Start-End: 308-981
tgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagta

SEQ ID NO: 130586 - DNA, 565 bp, Homo sapiens
  Payload ID: 5536
  Gene Symbol: EPB41L2
  Gene Name: erythrocyte membrane protein band 4.1-like 2
  ENST ID: ENST00000530707
  CDS Start-End: 212-565
acgcgcggtgcgggtcgggcccgctgtaggctcgcgtccgcgcccccagctgccgcctgcgccgtctgggagctgcggagagggacgcgtgtttcgtgctccgatccttacaattcccacacccaggccatctcaccacagatggcttgttttttctcctcctgcgcctgggggccgagggttgggagcatttttagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaacccctt

SEQ ID NO: 130587 - DNA, 588 bp, Homo sapiens
  Payload ID: 5536
  Gene Symbol: EPB41L2
  Gene Name: erythrocyte membrane protein band 4.1-like 2
  ENST ID: ENST00000531356
  CDS Start-End: 207-588
ttatagctcttattccctttgtagttagctatttaaatgccctgctctcacactgctggagccacattttatacaggtctgtgtcctcagcagctatcagcaagcacaaagcaattcctcatggaatgaatggatctttacaaaacccaaaagtacagtattaaaatcaagatttcatgggcagaggtaatgcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtg

SEQ ID NO: 130588 - DNA, 4186 bp, Homo sapiens
  Payload ID: 5536
  Gene Symbol: EPB41L2
  Gene Name: erythrocyte membrane protein band 4.1-like 2
  ENST ID: ENST00000527411
  CDS Start-End: 132-2939
gtcagggaatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattc

SEQ ID NO: 130589 - DNA, 4360 bp, Homo sapiens
  Payload ID: 5536
  Gene Symbol: EPB41L2
  Gene Name: erythrocyte membrane protein band 4.1-like 2
  ENST ID: ENST00000530757
  CDS Start-End: 2501-3106
ctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctttccccagcctccccaaggtctgggtctccttcctccccgctggtgtgcagcactatgtcccaatcacctccccttcattcattccttcccttatcctcatctttgggctacttctgtctgcttctcagtcagttcctttttctcttgccttttcccttcctctggctctatccctctgctatctggaggctaaagccgcctcctttaatgtttcttatgactgtgacttgaatgacaagctcgaggaagaggaagtagttgctggcatgcctacgtaagctcagtttgtggagtcaacacaatacactttatcttaaacccttcctaatatagagtgtaaatgtgtgcatacatttcaccactgattaccctcaacatagtagtacctgcacattttcacacacacaatattttagtgcatgagaaataagtgtagacacttctccttcattgataccattgaccagttccacacattctaagttaggagcgaaattgtaggattattttacaaatatctagatcaaagtagatttgtaacagaaggtgtgggggaggagggaaggaggagggaacctgtattgcccgtaacaatccatacagggtctctccattttgcaaacagatattaatgctgttcctttaggatgacatctttttgttttgatatagaatttaggatgcagtggacataactgttcctgatgtatattagtagaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggacacgtgctcccgagtcagaagggccttgcactggagccagggatgctgttaagccaccagtggtaaaaacagagatggtaacaatttctgatgcctcacaaaggacagaaatctccaccaaggaagtccccattgtccaaactgagaccaaaaccatcacatatgagtctccacagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 130590 - DNA, 3023 bp, Homo sapiens
  Payload ID: 5536
  Gene Symbol: EPB41L2
  Gene Name: erythrocyte membrane protein band 4.1-like 2
  ENST ID: ENST00000529208
  CDS Start-End: 216-3023
gtgcattttctagctgaggaatgaagtgacttggaaccaaactgggcttttctactgagcatgtccctctccagcagggtctggcttgggtggagccagtcttgctcgttaagcttttggacgctggatttccatcagctttccacagttttccaatgacaggaaatagcagacagcgggcttgatgtgcttaaaagctgccataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaa

SEQ ID NO: 130591 - DNA, 585 bp, Homo sapiens
  Payload ID: 5536
  Gene Symbol: EPB41L2
  Gene Name: erythrocyte membrane protein band 4.1-like 2
  ENST ID: ENST00000529709
  CDS Start-End: 49-585
aaaaacagcaactctaaactggctctggatatgtcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaa

SEQ ID NO: 130592 - DNA, 3090 bp, Homo sapiens
  Payload ID: 5536
  Gene Symbol: EPB41L2
  Gene Name: erythrocyte membrane protein band 4.1-like 2
  ENST ID: ENST00000524581
  CDS Start-End: 1470-2621
agaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattc

SEQ ID NO: 130593 - DNA, 962 bp, Homo sapiens
  Payload ID: 5536
  Gene Symbol: EPB41L2
  Gene Name: erythrocyte membrane protein band 4.1-like 2
  ENST ID: ENST00000527423
  CDS Start-End: 159-962
cagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagag

SEQ ID NO: 130594 - DNA, 3910 bp, Homo sapiens
  Payload ID: 5536
  Gene Symbol: EPB41L2
  Gene Name: erythrocyte membrane protein band 4.1-like 2
  ENST ID: ENST00000610431
  CDS Start-End: 99-2000
gaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 130595 - DNA, 4247 bp, Homo sapiens
  Payload ID: 5536
  Gene Symbol: EPB41L2
  Gene Name: erythrocyte membrane protein band 4.1-like 2
  ENST ID: ENST00000628542
  CDS Start-End: 183-2990
gtcgcgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 130596 - DNA, 4270 bp, Homo sapiens
  Payload ID: 5537
  Gene Symbol: EPB41L3
  Gene Name: erythrocyte membrane protein band 4.1-like 3
  ENST ID: ENST00000342933
  CDS Start-End: 410-3166
agaggccaggccatcatctaagtgggaataaagggctaaagctattggcattggcagctgtctccaggcgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactgaaagctct

SEQ ID NO: 130597 - DNA, 4706 bp, Homo sapiens
  Payload ID: 5537
  Gene Symbol: EPB41L3
  Gene Name: erythrocyte membrane protein band 4.1-like 3
  Uniprot ID: Q9Y2J2
  ENST ID: ENST00000341928
  CDS Start-End: 342-3605
cgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagtcacctgggcttggcactgactcatgtcccttgtcacccccatccacccattgtgcccccacatctcccacagagctccgtaggaggtgtaaggagaatgactgcaaactgccaggttatgagccgtccagagctgagcacctgcctggagagcccgccttggactctgatggcccagggaggccttacctaggggatcaagatgtggcttttagctacagacagcaaactggcaaggggaccaccctgttctccttctccttgcagctccctgagtcattcccctccctcctagatgatgatggatacctctctttccccaacctttctgaaaccaacctcctgccccagagcttgcagcattacctcccgatccgctcaccgtcccttgtgccctgtttcctcttcatctttttctttctgctgtctgcctccttctcagtgccatacgctctcactctctccttccctctggctctgtgcctctgctacctggagcccaaggcggcctccttgagcgcctccctagacaatgacccgagtgacagttcagaggaagagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactgaaagc

SEQ ID NO: 130598 - DNA, 3304 bp, Homo sapiens
  Payload ID: 5537
  Gene Symbol: EPB41L3
  Gene Name: erythrocyte membrane protein band 4.1-like 3
  ENST ID: ENST00000400111
  CDS Start-End: 396-1907
gcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgtt

SEQ ID NO: 130599 - DNA, 3972 bp, Homo sapiens
  Payload ID: 5537
  Gene Symbol: EPB41L3
  Gene Name: erythrocyte membrane protein band 4.1-like 3
  Uniprot ID: Q9Y2J2
  ENST ID: ENST00000544123
  CDS Start-End: 229-2880
gttatttgatttgccttggctgtggggaattctgtgctcagaagcaaggactggagcagtgaagtcattgtcctgcctggtgttgtgacatcactatggctcaaaggaaacaagggtggggcaggcaaaaccagaccatctgaagcatcttgctggctttaaaactttgcctgatcaatcaatgagactcctttctcaagttgaactgcattgcgagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactgaaagctct

SEQ ID NO: 130600 - DNA, 3370 bp, Homo sapiens
  Payload ID: 5537
  Gene Symbol: EPB41L3
  Gene Name: erythrocyte membrane protein band 4.1-like 3
  Uniprot ID: Q9Y2J2
  ENST ID: ENST00000540638
  CDS Start-End: 381-2978
aaagggctaaagctattggcattggcagctgtctccaggcgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaa

SEQ ID NO: 130601 - DNA, 572 bp, Homo sapiens
  Payload ID: 5537
  Gene Symbol: EPB41L3
  Gene Name: erythrocyte membrane protein band 4.1-like 3
  ENST ID: ENST00000581833
  CDS Start-End: 223-572
gtgacatcactatggctcaaaggaaacaagggtggggcaggcaaaaccagaccatctgaagcatcttgctggctttaaaactttgcctgatcaatcaatgagactcctttctcaagttgaactgcattgcgagtaatatcagcataaaaaatgaagaaccacagaatggctgcagatgttccttgtcttttccatgactgacatttttcataacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttct

SEQ ID NO: 130602 - DNA, 551 bp, Homo sapiens
  Payload ID: 5537
  Gene Symbol: EPB41L3
  Gene Name: erythrocyte membrane protein band 4.1-like 3
  ENST ID: ENST00000582703
  CDS Start-End: 280-551
gaagcatcttgctggctttaaaactttgcctgatcaatcaatgagactcctttctcaagttgaactgcattgcgagtaatatcagcataaaaaatgaagaaccacagaatggctgcagatgttccttgtcttttccatgactgacatttttcatgggaaaacacagcttggaaagtaaagaagattttttgttattgttttatcatgccgtttagaagctaaatgaagaagacaaagtatttatagtatcagataagaagttgctctgaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatc

SEQ ID NO: 130603 - DNA, 546 bp, Homo sapiens
  Payload ID: 5537
  Gene Symbol: EPB41L3
  Gene Name: erythrocyte membrane protein band 4.1-like 3
  ENST ID: ENST00000584651
  CDS Start-End: 61-546
gatcacagatgagcagaaatagtgcagctgtattgaccattactcaaagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaag

SEQ ID NO: 130604 - DNA, 542 bp, Homo sapiens
  Payload ID: 5537
  Gene Symbol: EPB41L3
  Gene Name: erythrocyte membrane protein band 4.1-like 3
  ENST ID: ENST00000584670
  CDS Start-End: 100-542
aaaactttgcctgatcaatcaatgagactcctttctcaagttgaactgcattgcgagtaatatcagcataaaaaatgaagaaccacagaatggctgcagatgttccttgtcttttccatgactgacatttttcattttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaa

SEQ ID NO: 130605 - DNA, 552 bp, Homo sapiens
  Payload ID: 5537
  Gene Symbol: EPB41L3
  Gene Name: erythrocyte membrane protein band 4.1-like 3
  ENST ID: ENST00000580989
  CDS Start-End: 178-552
tttggtactaagctagataatgttgggggttaacttgatgagctgaatgttagcctactctggacctgaactgtaatcttccagtggacattactaggcatgcgccattcacccaagaaaaactgaagtgaatcctagataggatcctttttttgtgtgtgctcagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgat

SEQ ID NO: 130606 - DNA, 567 bp, Homo sapiens
  Payload ID: 5537
  Gene Symbol: EPB41L3
  Gene Name: erythrocyte membrane protein band 4.1-like 3
  ENST ID: ENST00000585142
  CDS Start-End: 229-567
gttatttgatttgccttggctgtggggaattctgtgctcagaagcaaggactggagcagtgaagtcattgtcctgcctggtgttgtgacatcactatggctcaaaggaaacaagggtggggcaggcaaaaccagaccatctgaagcatcttgctggctttaaaactttgcctgatcaatcaatgagactcctttctcaagttgaactgcattgcgagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaa

SEQ ID NO: 130607 - DNA, 553 bp, Homo sapiens
  Payload ID: 5537
  Gene Symbol: EPB41L3
  Gene Name: erythrocyte membrane protein band 4.1-like 3
  ENST ID: ENST00000582592
  CDS Start-End: 265-553
acagtcatgcggagaagctacactgggaaccaggggaaatattagaagaagaatctgaaggacactataaaatactgtgcagttattgcttcctgccccggcttgatttttggagtgttgaatttaaggagagaatctggatgtgatagaaagcaattgcttttacctttccgggatctttctgtgtttcacagagaatattcctggaggaatagaagccggagagtcaatgctacagtaactttgaaattgctgcactgcagcatgccatctttcatctgtctctatctgtgctcaaagtctctcttaggatttggagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaa

SEQ ID NO: 130608 - DNA, 492 bp, Homo sapiens
  Payload ID: 5537
  Gene Symbol: EPB41L3
  Gene Name: erythrocyte membrane protein band 4.1-like 3
  ENST ID: ENST00000580308
  CDS Start-End: 112-492
ccatctcagtggtgaagttgacaagtcatctgtccagtgtgtggaataggatggggtttggtagcatctccctctctgtggttctcttgagcctttcacgaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagag

SEQ ID NO: 130609 - DNA, 500 bp, Homo sapiens
  Payload ID: 5537
  Gene Symbol: EPB41L3
  Gene Name: erythrocyte membrane protein band 4.1-like 3
  ENST ID: ENST00000584015
  CDS Start-End: 120-500
ggcgggtggcggctggcgggccgcgggaggggccctgcgctcagcgcgcggcggcagcgggctcgtcccgggtgcaggcgcgggcgggcgcagcgcggggccgataagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagag

SEQ ID NO: 130610 - DNA, 496 bp, Homo sapiens
  Payload ID: 5537
  Gene Symbol: EPB41L3
  Gene Name: erythrocyte membrane protein band 4.1-like 3
  ENST ID: ENST00000580179
  CDS Start-End: 258-496
agaccatctgaagcatcttgctggctttaaaactttgcctgatcaatcaatgagactcctttctcaagttgaactgcattgcgagtaatatcagcataaaaaatgaagaaccacagaatggctgcagatgttccttgtcttttccatgactgacatttttcattcccaggcattcttctaggactgaagatggaagagaagcaagcagatacaaacccctgctgttctggagcttctattgcacagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatca

SEQ ID NO: 130611 - DNA, 553 bp, Homo sapiens
  Payload ID: 5537
  Gene Symbol: EPB41L3
  Gene Name: erythrocyte membrane protein band 4.1-like 3
  ENST ID: ENST00000578503
  CDS Start-End: 68-553
gcagagggaaggtagtggcacggagtgacctgctcttcccttttttctgcttgcagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaag

SEQ ID NO: 130612 - DNA, 596 bp, Homo sapiens
  Payload ID: 5537
  Gene Symbol: EPB41L3
  Gene Name: erythrocyte membrane protein band 4.1-like 3
  ENST ID: ENST00000579951
  CDS Start-End: 1-333
tcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggtagtgtgtgtgagacggtaaataccctggcagagaaacaaagaaaaacctgttggtcctacagtttcaatgctattcctctagtccagcatgtattccgaagaaaattccgaattaactttccaatatatgatttatgattccttttgtaatcattgtacctcatttgtaaattgtggatatagatctagctcataagtctccacctcaccactgatcatgcatgttccacctcctttttgtttctgcccttctgtgatttcccggggataggcgctggctca

SEQ ID NO: 130613 - DNA, 564 bp, Homo sapiens
  Payload ID: 5537
  Gene Symbol: EPB41L3
  Gene Name: erythrocyte membrane protein band 4.1-like 3
  ENST ID: ENST00000580316
  CDS Start-End: 1-564
gttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatgg

SEQ ID NO: 130614 - DNA, 551 bp, Homo sapiens
  Payload ID: 5537
  Gene Symbol: EPB41L3
  Gene Name: erythrocyte membrane protein band 4.1-like 3
  ENST ID: ENST00000581292
  CDS Start-End: 1-551
aaggctgaggaggagcgggacgaggaagaggacaaacggaggaagggggaagaagtcacgcccatctcggccatccggcacgagggaaaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcct

SEQ ID NO: 130615 - DNA, 583 bp, Homo sapiens
  Payload ID: 5537
  Gene Symbol: EPB41L3
  Gene Name: erythrocyte membrane protein band 4.1-like 3
  ENST ID: ENST00000581387
  CDS Start-End: 1-583
gtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaccaaagaagaaacagagatttctgaaaaagttatatttttgcagcaaggaagcgctccattccttgagtctcagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatag

SEQ ID NO: 130616 - DNA, 569 bp, Homo sapiens
  Payload ID: 5537
  Gene Symbol: EPB41L3
  Gene Name: erythrocyte membrane protein band 4.1-like 3
  ENST ID: ENST00000580647
  CDS Start-End: 1-569
gaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagaggtcagtagtcagaccaaagaagaaacagagatttctgaaaaagttatatttttgcagcaaggaagcgctccattccttgagtctcagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtgg

SEQ ID NO: 130617 - DNA, 591 bp, Homo sapiens
  Payload ID: 5537
  Gene Symbol: EPB41L3
  Gene Name: erythrocyte membrane protein band 4.1-like 3
  ENST ID: ENST00000579271
  CDS Start-End: 1-591
gaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagccaagtgtgataaagaaaatgcaggaaggagactctgctgactctgtggttacttctcgtcaaataattttccagaaaactgtcccatcaaccctagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaat

SEQ ID NO: 130618 - DNA, 3190 bp, Homo sapiens
  Payload ID: 5537
  Gene Symbol: EPB41L3
  Gene Name: erythrocyte membrane protein band 4.1-like 3
  ENST ID: ENST00000545076
  CDS Start-End: 538-2808
ctttggcgcgtcctgctcagaagccggggagctcctggccggcggctggcggggaagcgcggcgcgggaggaggtattgggagacaaaagaagctcatctataaacattttccatgaatcaagcagaaacttgggttttaaaggattcgcatagaacgggatgccacaggcaaggacagatcccctgaggctgtggaatgagtggggacatccccgcccatctctggtcttgactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaac

SEQ ID NO: 130619 - DNA, 973 bp, Homo sapiens
  Payload ID: 5537
  Gene Symbol: EPB41L3
  Gene Name: erythrocyte membrane protein band 4.1-like 3
  ENST ID: ENST00000578524
  CDS Start-End: 1-973
gactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacag

SEQ ID NO: 130620 - DNA, 489 bp, Homo sapiens
  Payload ID: 5537
  Gene Symbol: EPB41L3
  Gene Name: erythrocyte membrane protein band 4.1-like 3
  ENST ID: ENST00000580866
  CDS Start-End: 1-110
agcagttcgccgccgctgcagcgcacagcaccccggtgcggagggaggtgagcccaggccagaaaactaatgacgcagtgtttgctgagctgctccaggatcggctttaaccttggtctcttagccctagaggcagctatgaggggtcatctgctgttccccttctagccccaggcagatgaaaatgtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaag

SEQ ID NO: 130621 - DNA, 4553 bp, Homo sapiens
  Payload ID: 5538
  Gene Symbol: EPB42
  Gene Name: erythrocyte membrane protein band 4.2
  Uniprot ID: P16452
  ENST ID: ENST00000300215
  CDS Start-End: 459-2624
tggatatgggactcctgtttgtggcctcctctcttccagagtcttccagtgcagtccagataacatctctgagagtctcttgagaccactgaagcaagaggcttcaaggtttgttctaggcttctctagttggcaggtcttccccatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacagggtgagccaagccagcgctcgacagggcttgctggactgtatgcagcccccgcagcatcacctgttttcattaaaggaagtgggatggatgccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagagaaactttgcgtctcagtgtttgtgttgctataaaggaataactgaggctgggtagtttaaaagaaaagagctttatttggctcacggctctgcaggctgtacaagaaacagtgagggcttcaggctgcttccacttatgcaggaagatgaagggaggcaacgtgagcagagatcacagggcaagaatgggttgaggggtaggggtaagtgccaggtgccagcctcgttttaacagccagctctggggtgggggagggacatatagagcgagaacttactcattaccccaccaatggaacgaagccattcatgagggatccaaacacctcccattaggccccacctccaacactgggaatccaatttcagcatgaggtttgcagggttgaatatccaaactacatcactttatcagataaatgagtagtcattcaggttgaaaaggtgctcagatacctttaaggagtacattcagattgttcaggttcaggttttttgcaaccattttactgctcattaatacattcattaacttacagataagggaaaggacctaacacttaaatcattctaatatttctgatgaagtgggatattatcccaaaatggaatttttaggtaatcttaaaattacattgatcaagctgggctcggtggctcacatctgtaatcccagcactttgggaggctgacgtgggcagatcacctgaggtcaggagtttgagaccagcctggccaacatggtgaaaccccatctctactaaaaatacaaaaattagctggacatggtggtgtgcatctgtagtcccagctacttgagaggctgaagccagagaattgcttgagaacctgggaggcggaggttgcagtgagccgagagtgtgccactgcactccagcttgggggacagagcaagactccatctcaaaaaaaaaaaaaaaaaaaaaaaaattacattgatcagtgctttccctgatcattatccttaaagatccaaacatgactgaacgaagttatacaatacaggacctgagagaataattcagctagaggtaagtctttatattagagttctatattcattaagtatcccacaattaaagtctgatgttaataacatgaatttggtccagtagagaaatataaaagtatataaaaaataggctctatatgaaaggataaaagaactagactgttgtacaatgttattattttgtttatgttattttgttgccttgacactctgtcagtttgattttagttccttcccttcatgacacttgttaacaatacaaaatggcacttcaaaacagtaagctaaaactcatttggcttaaggaatttcaaccccaaccccaagtatacattagtcactcaaagaatgactgctgttgctgattatacctaaagacagcagaaaggcatatgttatgaattacacctacaaaaggaagatgatgggcatgagaggtggcggagacctgtaggacatgcataatgccctattcagctcaccagaatatacatcattatagatttacactgctttccaatatgcagtcttctagactgatgcaaaagtataattaagtggtgatggttttgcaaaaggatgaactgaaaaggcccttaaaattacataaaatctcttacacactaaaaaatttttgatttataaaaatttggtatttacatttggggacacacgtaaccaaggacaacacaagtatgtataaggaaaataaatctgttcaataaggtgggcaaacctaacaaatgagctcaatgccaatatattttagagacatggagtaatctgtgataatattcagaaggacttgctgataataatatata

SEQ ID NO: 130622 - DNA, 2374 bp, Homo sapiens
  Payload ID: 5538
  Gene Symbol: EPB42
  Gene Name: erythrocyte membrane protein band 4.2
  Uniprot ID: P16452
  ENST ID: ENST00000441366
  CDS Start-End: 227-2302
aactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagag

SEQ ID NO: 130623 - DNA, 2098 bp, Homo sapiens
  Payload ID: 5538
  Gene Symbol: EPB42
  Gene Name: erythrocyte membrane protein band 4.2
  ENST ID: ENST00000540029
  CDS Start-End: 185-2026
gaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactgaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagag

SEQ ID NO: 130624 - DNA, 574 bp, Homo sapiens
  Payload ID: 5538
  Gene Symbol: EPB42
  Gene Name: erythrocyte membrane protein band 4.2
  ENST ID: ENST00000569204
  CDS Start-End: 1-574
gtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgcct

SEQ ID NO: 130625 - DNA, 1813 bp, Homo sapiens
  Payload ID: 5538
  Gene Symbol: EPB42
  Gene Name: erythrocyte membrane protein band 4.2
  ENST ID: ENST00000568508
  CDS Start-End: 1-1632
ccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgtt

SEQ ID NO: 130626 - DNA, 679 bp, Homo sapiens
  Payload ID: 5538
  Gene Symbol: EPB42
  Gene Name: erythrocyte membrane protein band 4.2
  ENST ID: ENST00000565459
  CDS Start-End: 1-442
ccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctgggtaatgctctatggccccaccagacaccccccgacacacacacacacatggcccctgccttgggcaggcagcagccacagggcaccccctgcagtctctagagatggctttgagcccctgctgctcactctcatgttctctctcattcattcattcaacacatatttattgggcctgaagcaggaaaaaaacacgatgccaactgcagtcagataagtaaacagacccttcgtagcagtgtgagaagtgtttgctgagtttaacagagtacagtggcaggagagcacctccccccaggctggaataagctgcccccaaataaattgtactgcatggaa

SEQ ID NO: 130627 - DNA, 2227 bp, Homo sapiens
  Payload ID: 5538
  Gene Symbol: EPB42
  Gene Name: erythrocyte membrane protein band 4.2
  Uniprot ID: P16452
  ENST ID: ENST00000622454
  CDS Start-End: 301-2160
ccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctagg

SEQ ID NO: 130628 - DNA, 4387 bp, Homo sapiens
  Payload ID: 5539
  Gene Symbol: EDRF1
  Gene Name: erythroid differentiation regulatory factor 1
  Uniprot ID: Q3B7T1
  ENST ID: ENST00000337623
  CDS Start-End: 106-3720
aagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaa

SEQ ID NO: 130629 - DNA, 4128 bp, Homo sapiens
  Payload ID: 5539
  Gene Symbol: EDRF1
  Gene Name: erythroid differentiation regulatory factor 1
  Uniprot ID: Q3B7T1
  ENST ID: ENST00000356792
  CDS Start-End: 233-3949
ggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggaagtgagcctcttgaaccctcatacatagtggggcatgtggcctcagcccccaaagaacaaaacctgattactttattcaatgacggggagcacagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttc

SEQ ID NO: 130630 - DNA, 1095 bp, Homo sapiens
  Payload ID: 5539
  Gene Symbol: EDRF1
  Gene Name: erythroid differentiation regulatory factor 1
  ENST ID: ENST00000368813
  CDS Start-End: 1-954
tctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggtgtgccacaggcttggaccacgtggttcacagtgggactgtgcagtctagctcatgcttatttgagtattcagaaaaggggtagaaatattagagttttgatatttgctctgtatttatttatttattttttgagacggagtttcgctcttgttgcccaagctggagtgcaatggtgcaatcttggctcactgaaacctccgcctcccgggttcaagcaattctcctgcctcagcctcccaagtagctggaattacaggcatgcgccaccatgcccggctagcccaccttggcctcccaaggtgctgggattacaggtgtgagccaccacgcctggcctgctgttttattcatttcctaattttaagattaagcatgatcttgtgtatttgtataaaatggtttttaagtattttataattactgtttatataactagaactaaatataaagtaagatatgaa

SEQ ID NO: 130631 - DNA, 4123 bp, Homo sapiens
  Payload ID: 5539
  Gene Symbol: EDRF1
  Gene Name: erythroid differentiation regulatory factor 1
  Uniprot ID: Q3B7T1
  ENST ID: ENST00000368815
  CDS Start-End: 233-2014
ggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggaagtgagcctcttgaaccctcatacatagtggggcatgtggcctcagcccccaaagaacaaaacctgattactttattcaatgacggggagcacagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagattgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttc

SEQ ID NO: 130632 - DNA, 4243 bp, Homo sapiens
  Payload ID: 5539
  Gene Symbol: EDRF1
  Gene Name: erythroid differentiation regulatory factor 1
  Uniprot ID: Q3B7T1
  ENST ID: ENST00000419769
  CDS Start-End: 294-2684
gcggagcctaggagtcagataccgcgagaagtagtctcccgaagaggttcggacaagcgcaggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggaagtgagcctcttgaaccctcatacatagtggggcatgtggcctcagcccccaaagaacaaaacctgattactttattcaatgacggggagcacagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggctttaaaactgggaagtagaataatctgatccgcagcagcgatatccctccctcttacctcagcacagtgtgtaaccacgctgccattaacacagtgaatgaagtaaaagatgagtcttctgaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaa

SEQ ID NO: 130633 - DNA, 4181 bp, Homo sapiens
  Payload ID: 5539
  Gene Symbol: EDRF1
  Gene Name: erythroid differentiation regulatory factor 1
  ENST ID: ENST00000481600
  CDS Start-End: 294-1325
gcggagcctaggagtcagataccgcgagaagtagtctcccgaagaggttcggacaagcgcaggcgcactacaattcccgccctggccgcgaaggtggcacccgcagcgggaggcggggccgggccttcgggacaaagatcgcgagatttaatggcgagtcacagctacttcttcctggcagagaccggaagtgcggtccgcggagcgtctctggcgcttaccctgctttgggcctgcgttgctgctgctgctcctccgctcccccgtcgtatcgcctgccctggatcgaagtgatgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaaaacataaaaaaactcctgaaaattccctacagcaagtcgcacgtgagcatggcagtacaccgcataggaaggactctcttactagatgagctagatattcaagaactctttatgagatcgtctcagactggtgactggacatggttgaaagagttttatcaaagactcattgatcagaagtggcagaggaagaaaaagagcaaagagcactggtatcaaaaggcaattctttccaagtttttatattacagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcagggaagtgagcctcttgaaccctcatacatagtggggcatgtggcctcagcccccaaagaacaaaacctgattactttattcaatgacggggagcacagtcagggtcttaaaaatgattttgttcggaatattctatggacatttgaagatatccatatgttggtcggctccaacatgcccatatttggaggaggcagatacccagcagtcagcttacgtctcagaaatgtatatttttagggataacaacaaaccaattaatgtgctaactggaattgactattggttggacaacttgatatgcaatgtgccagagcttgtgatgtgttttcatgtaaatggaattgtacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccgttgatcaagaacaggtactacccctttttttcatttcaaacttgaaactgtgaataaggtaagaaaactattttgaataaataaactatttatttaaaatgtc

SEQ ID NO: 130634 - DNA, 436 bp, Homo sapiens
  Payload ID: 5539
  Gene Symbol: EDRF1
  Gene Name: erythroid differentiation regulatory factor 1
  ENST ID: ENST00000525358
  CDS Start-End: 1-71
agtctcggttgtcatttcttctccttcagtccattaaactgctatcttcaactaaaaagaaaacaaggtgatgcaggcatttcatcatcatatgacaactgcattggcattgacctgctagaaattctagcagtagcagtttgttaggccaaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacag

SEQ ID NO: 130635 - DNA, 945 bp, Homo sapiens
  Payload ID: 5539
  Gene Symbol: EDRF1
  Gene Name: erythroid differentiation regulatory factor 1
  ENST ID: ENST00000530795
  CDS Start-End: 1-454
ggaaggggcttcatggcctgctcccttcgaaatgccttcttcagtttctgaagatcccagtgcttccagtcagggaagtgagcctcttgaaccctcatacatagtggggcatgtggcctcagcccccaaagaacaaaacctgattactttattcaatgacggggagcacagtcagggtcttaaaaatgattttgttcggaatattctatggacatttgaagatatccatatgttggtcggctccaacatgcccatatttggaggaggcagatacccagcagtcagcttacgtctcagggataacaacaaaccaattaatgtgctaactggaattgactattggttggacaacttgatatgcaatgtgccagagcttgtgatgtgttttcatgtaaatggaattgtacagctacctcacatgctgttattcctatttgatggaaagagagactgaggatcaaggagctcaaaaatatgaaatgataaagacagaagaaattcccaatttggaaaattctaatttttctactaaagtcataaaagacattgcacagaatattttatcatttttgaaatctaattgtaccaaagaaggacatacctattggctctttaaagcaagtggcagcgatatagtgaagctctatgacctcactactctttgtgaagaaactgaagacaaataccaaaatccattcacaatgccggtagccattctcttgtacaaggttgcttgcaacatgatgatgaagaagaatcaaaataagaaacactatggaactattagaacattgcttcttaattgtctgaaattactggacaaaagtaggcatcctcaaattattgcttccgccaattacatgctttcagaactttttcaattggatgaacctaaaaaggaagaaaattcagaatctcctttaaatgagaattctgatgaaagtt

SEQ ID NO: 130636 - DNA, 1330 bp, Homo sapiens
  Payload ID: 5540
  Gene Symbol: EPO
  Gene Name: erythropoietin
  Uniprot ID: P01588
  ENST ID: ENST00000252723
  CDS Start-End: 182-763
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggataacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaa

SEQ ID NO: 130637 - DNA, 2411 bp, Homo sapiens
  Payload ID: 5541
  Gene Symbol: EPOR
  Gene Name: erythropoietin receptor
  Uniprot ID: P19235
  ENST ID: ENST00000222139
  CDS Start-End: 106-1632
tcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcaggc

SEQ ID NO: 130638 - DNA, 1825 bp, Homo sapiens
  Payload ID: 5541
  Gene Symbol: EPOR
  Gene Name: erythropoietin receptor
  ENST ID: ENST00000588859
  CDS Start-End: 78-437
gacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggctggcacgccctctatgggccggggcgcgaacactcccgcgatcaccgctggaacgcgaccccaaacatcaggctgggataacaacgcctccaaatcgaggggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttg

SEQ ID NO: 130639 - DNA, 1850 bp, Homo sapiens
  Payload ID: 5541
  Gene Symbol: EPOR
  Gene Name: erythropoietin receptor
  ENST ID: ENST00000586890
  CDS Start-End: 78-470
gacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgatcgtggtcactggagggaaacctgcgggtccagggctggcacgccctctatgggccggggcgcgaacactcccgcgatcaccgctggaacgcgaccccaaacatcaggctgggataacaacgcctccaaatcgaggggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgc

SEQ ID NO: 130640 - DNA, 2086 bp, Homo sapiens
  Payload ID: 5541
  Gene Symbol: EPOR
  Gene Name: erythropoietin receptor
  Uniprot ID: P19235
  ENST ID: ENST00000592375
  CDS Start-End: 106-1092
tcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccaggtaggtggcctggttgtcccctcagtgcctgggcttccctgcttcttgcagccaaactgcaggcctctctgagcaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaa

SEQ ID NO: 130641 - DNA, 1931 bp, Homo sapiens
  Payload ID: 5541
  Gene Symbol: EPOR
  Gene Name: erythropoietin receptor
  ENST ID: ENST00000591958
  CDS Start-End: 78-908
gacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaaggctggggcggggctggcagtcccgagctcgaggtcttgaacgccgcgcccagctcagctggccgctgggtgggcaggtgtgcgccagtggtgacggcgggggacacggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagaggggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttg

SEQ ID NO: 130642 - DNA, 1266 bp, Homo sapiens
  Payload ID: 5542
  Gene Symbol: ERAS
  Gene Name: ES cell expressed Ras
  Uniprot ID: Q7Z444
  ENST ID: ENST00000338270
  CDS Start-End: 252-953
cgtgaggagggaaggagagatggggggacgtgggacagggagaaaacaacataaatcatatatatatagcatgcaaattggaaggtgatcagcacacaataggcattcaataaatgttgaaataatgacaccccactgtctccttgccctcaaatggtctcccctaacgtatcccctgttgtcttgcttcttctcttcccacttgcagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattc

SEQ ID NO: 130643 - DNA, 3216 bp, Homo sapiens
  Payload ID: 5543
  Gene Symbol: ESF1
  Gene Name: ESF1 nucleolar pre-rRNA processing protein homolog
  Uniprot ID: Q9H501
  ENST ID: ENST00000202816
  CDS Start-End: 109-2664
gcggacggtgagtggggatggactggagttgaagagctcgagatgaagggcttgagggcgtgtgttatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacggaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaataataggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcatta

SEQ ID NO: 130644 - DNA, 1470 bp, Homo sapiens
  Payload ID: 5543
  Gene Symbol: ESF1
  Gene Name: ESF1 nucleolar pre-rRNA processing protein homolog
  ENST ID: ENST00000617257
  CDS Start-End: 85-1455
gaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctttgatttgaatgacccatactttg

SEQ ID NO: 130645 - DNA, 3531 bp, Homo sapiens
  Payload ID: 5544
  Gene Symbol: ESPN
  Gene Name: espin
  Uniprot ID: B1AK53
  ENST ID: ENST00000377828
  CDS Start-End: 169-2733
agcggagcgccaggcagcgcggagcggaggccaggcccacagccgctccgcctcccggcccgcagatccccgacggccgcaccgcgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggacaaagacaattctggtgccacagtcttgcatctggctgcccgcttcggccaccccgaggtggtgaactggctcttgcatcatggcggtggggaccccaccgcggccacagacatgggcgccctgcctatccactacgctgccgccaaaggagacttcccctccctgaggcttctcgtcgagcactaccctgagggagtgaatgcccaaaccaagaacggtgccacgcccctgtacctggcgtgccaggagggccacctggaggtgacccagtacctggtgcaggaatgcggcgcagacccgcacgcgcgcgcccacgacggcatgaccccgctgcacgccgcggcgcagatgggccacagcccagtcatcgtgtggttggtgagctgcaccgacgtgagcctgtccgagcaggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgcgacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccacacccccaccacccccacccagcttccccccgccacccccgcccccaggcacccaactgcccccacccccacctggctacccagctcccaagcctcctgtaggaccacaggcagctgacatctacatgcagaccaagaacaaactccgccacgtggagacagaggccctcaagaaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactca

SEQ ID NO: 130646 - DNA, 1338 bp, Homo sapiens
  Payload ID: 5544
  Gene Symbol: ESPN
  Gene Name: espin
  ENST ID: ENST00000416731
  CDS Start-End: 220-1086
atcaggtaacgcaggtgtcgggtcctgccgcccccacagccaggtgcacagcgggggccaccagcaccgtggcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagctggggaggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgc

SEQ ID NO: 130647 - DNA, 641 bp, Homo sapiens
  Payload ID: 5544
  Gene Symbol: ESPN
  Gene Name: espin
  ENST ID: ENST00000418286
  CDS Start-End: 1-641
gacggcatgaccccgctgcacgccgcggcgcagatgggccacagcccagtcatcgtgtggttggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgcgacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccac

SEQ ID NO: 130648 - DNA, 750 bp, Homo sapiens
  Payload ID: 5544
  Gene Symbol: ESPN
  Gene Name: espin
  ENST ID: ENST00000434576
  CDS Start-End: 1-565
tgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacagatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataa

SEQ ID NO: 130649 - DNA, 1869 bp, Homo sapiens
  Payload ID: 5544
  Gene Symbol: ESPN
  Gene Name: espin
  Uniprot ID: B1AK53
  ENST ID: ENST00000461727
  CDS Start-End: 220-1086
atcaggtaacgcaggtgtcgggtcctgccgcccccacagccaggtgcacagcgggggccaccagcaccgtggcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgg

SEQ ID NO: 130650 - DNA, 270 bp, Homo sapiens
  Payload ID: 5544
  Gene Symbol: ESPN
  Gene Name: espin
  ENST ID: ENST00000478323
  CDS Start-End: 187-270
tgctgcacccctcgacggccgctggccgcgagtccccaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggcggcgctgcttcctgggaaccatgttcctaacggctgcgccgcggaccccaaggcgtccagggag

SEQ ID NO: 130651 - DNA, 455 bp, Homo sapiens
  Payload ID: 5544
  Gene Symbol: ESPN
  Gene Name: espin
  ENST ID: ENST00000632803
  CDS Start-End: 274-455
gcgggtgcctgaccgggggcgggagcagggtcgtggcgtccgaacctccgggctgcagggggcgcggagcgggcgggctggcccagaaaacaaatcctgcggtgtcgcatttcctgcaacgtgagccagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctgg

SEQ ID NO: 130652 - DNA, 1494 bp, Homo sapiens
  Payload ID: 5544
  Gene Symbol: ESPN
  Gene Name: espin
  ENST ID: ENST00000633239
  CDS Start-End: 1-714
ggctgcgggcagcgccgctcctcctcgtccaccggcaaagtgagagtcctgaggcacaggaagagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatc

SEQ ID NO: 130653 - DNA, 813 bp, Homo sapiens
  Payload ID: 5544
  Gene Symbol: ESPN
  Gene Name: espin
  ENST ID: ENST00000475228
  CDS Start-End: 278-813
catgaccctcgcccgctgcccactgtgagaaccagggggtctaggaagtcagctgctgcacccctcgacggccgctggccgcgagtccccaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtc

SEQ ID NO: 130654 - DNA, 4836 bp, Homo sapiens
  Payload ID: 5545
  Gene Symbol: ESPNL
  Gene Name: espin-like
  Uniprot ID: Q6ZVH7
  ENST ID: ENST00000343063
  CDS Start-End: 264-3281
tacccagccctgacctagcctggtgtgggcctttccctgtgccctgtactccatcctcccagctccaggcacctggcaccctcacactgtgggagtggcttgggcaggtcctcaaggcctgtccccccacccgaccccaccccaccgcctcccatctgccctgtggcagcttatcgggtaaccagagccggcagcttcatccacgtctgaaacaggaagccccagcctgtgcatgagtcgccactgagagcccgggccagaggatggagaagcagcgggcactcgtggccgccaaggatggggatgtggcgacgttggagcggctgctggaggctggcgccctgggcccgggcatcaccgatgctctgggggccggcctggttcaccacgccacccgggctggccacctggactgcgtcaagttcttggtgcagcgggcccagctgcccggcaaccagcgggcccacaacggggccaccccagcgcatgacgccgctgccacgggcagcctggccgagctgtgctggctggtccgcgaggggggctgcggtctgcaggaccaagatgcctcgggcgtctccccgctgcacctggccgcccgttttggacacccagtgctggtggagtggctgctccacgagggccactcggccacgctagagacccgggagggagcccggccgctgcaccacgctgccgtcagtggggacctgacctgcctcaagctcctgacagccgcgcatggcagcagcgtgaaccggcggacacgcagtggcgcctccccactctacctggcctgccaggagggccacctgcacctggcccagttcctggtgaaggactgtggcgctgacgtgcaccttcgtgctctcgatggcatgagcgccctgcacgctgccgccgcccgtggccactactccctcgtcgtctggctggtcacattcaccgacatcggactcacggcacgggacaatgagggggccacggccctgcactttgcagcccgaggcggccacacgcccattctagaccgactcctgctcatgggtacccccatcctgagagactcctggggtgggacccccctccacgacgcagcagagaacgggcagatggagtgctgccagaccctagtctcccaccacgtggacccctccctgcgggatgaagatggttacacggcggcagacctggcggagtaccatggacaccgggactgcgcccagtacctgcgggaggtggcccagccggtgcccctgctgatgacgcccccaccaccaccgttccccccacctccactgttggccacgaggcgctccctggaggatggaagaagaggaggcccagggccagggaaccccagccccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgca

SEQ ID NO: 130655 - DNA, 4441 bp, Homo sapiens
  Payload ID: 5545
  Gene Symbol: ESPNL
  Gene Name: espin-like
  Uniprot ID: Q6ZVH7
  ENST ID: ENST00000409169
  CDS Start-End: 1-2886
atggagaagcagcgggcactcgtggccgccaaggatggggatgtggcgacgttggagcggctgctggaggctggcgccctgggcccgggcatcaccgatgctctgggggccggcctggttcaccacgccacccgggctggccacctggactgcgtcaagttcttggtgcagcgggcccagctgcccggcaaccagcgggcccacaacggggccaccccagcgcatgacgccgctgccacgggcagcctggccgagctgtgctggctggtccgcgaggggggctgcggtctgcaggaccaagatgcctcgggcgtctccccgctgcacctggccgcccgttttggacacccagtgctggtggagtggctgctccacgagggccactcggccacgctagagacccgggagggagcccggccgctgcaccacgctgccgtcagtggggacctgacctgcctcaagctcctgacagccgcgcatggcagcagcgtgaaccggcggacacgcagtggcgcctccccactctacctggcctgccaggagggccacctgcacctggcccagttcctggtgaaggactgtggcgctgacgtgcaccttcgtgctctcgatggcatgagcgccctgcacgctgccgccgcccgtggccactactccctcgtcgtctggctggtcacattcaccgacatcggactcacggcacgggacaatgagggggccacggccctgcactttgcagcccgaggcggccacacgcccattctagaccgactcctgctcatgggtacccccatcctgagagactcctggggtgggacccccctccacgacgcagcagagaacgggcagatggaggtgcccctgctgatgacgcccccaccaccaccgttccccccacctccactgttggccacgaggcgctccctggaggatggaagaagaggaggcccagggccagggaaccccagccccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgca

SEQ ID NO: 130656 - DNA, 3610 bp, Homo sapiens
  Payload ID: 5545
  Gene Symbol: ESPNL
  Gene Name: espin-like
  Uniprot ID: Q6ZVH7
  ENST ID: ENST00000409506
  CDS Start-End: 142-2055
gcggtgtgccgcaggctctcccatcgaccaggcgggggcgggccccactgactccccagagaaggtccagtggggcccccgaggtgttctggggcagggtgggctggggtcagctcccagctcgcagatcgttcaggagccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgca

SEQ ID NO: 130657 - DNA, 476 bp, Homo sapiens
  Payload ID: 5545
  Gene Symbol: ESPNL
  Gene Name: espin-like
  ENST ID: ENST00000423032
  CDS Start-End: 230-476
gtgccgcaggctctcccatcgaccaggcgggggcgggccccactgactccccagagaaggtccagtggggcccccgaggtgttctggggcagggtgggctggggtcagctcccagctcgcagatcgttcaggaggtcagctctgcccccagggccggatccccgaggctctgggtctctgctccccagcccttgccctttctgcaacacccttcttcttcttggcagccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagc

SEQ ID NO: 130658 - DNA, 3673 bp, Homo sapiens
  Payload ID: 5545
  Gene Symbol: ESPNL
  Gene Name: espin-like
  ENST ID: ENST00000612395
  CDS Start-End: 2358-2780
ccgactcctgctcatgggtacccccatcctgagagactcctggggtgggacccccctccacgacgcagcagagaacgggcagatggaggtgcccctgctgatgacgcccccaccaccaccgttccccccacctccactgttggccacgaggcgctccctggaggatggaagaagaggaggcccagggccagggaaccccagccccatgtccctcagcccggcctggcctggccatcctgaccagcctcttcccagggagcagatgaccagcccggcccctccgaggatcatcaccagtgccacggctgaccccgaggggacagagacggcgctggcgggggacacctcagatggcctggccgcactacagctggatgggctgccctcaggcgacatcgacgggctggtgcccacgcgggatgagcgcggccagcccatcccagagtggaagcggcaggtgatggtgcggaagctgcaggcgcgcctgggcgcagagagctccgcagaggcccaggacaatggtgggagctcaggccccacggagcaggcggcctggaggtactcacagactcatcaggccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccggcccctgcaggacacctgcagggaggcctcggccagcccccctcggagcgaggcccagcgccagatccaggagtggggggtgtctgtgcggacgctgcggggcaacttcgagtcggcctctggcccactctgtggcttcaaccctggcccctgcgagccgggggcccagcacaggcagtgcctgagtggctgctggccagccctgcctaagccccgcagtggcctggcttcaggggagcccaggcctggcgacacagaggaggccagcgactctggcatcagctgcgaggaggtgccatcagaggcgggtgccgcagccggcccagacctggccagcctgcgcaaggagcgcatcatcatgctcttcctcagccactggaggagatcggcctacacgccggccctcaagacagtggcctgcaggaccctaggagcccgccacgcggggttgcggggccaggaggccgccaggagccctgggccaccctccccgcccagcgagggcccccggctgggccacctgtggcagcagcgcagcaccatcacccacctgctgggcaactggaaggccatcatggctcacgtgcccgcccggcagctgcggcggctgagccggcagccccgcggggctttgtcccccgagcagttcctgccccacgtggacggggctccggtgccctacagcagcctctcactggatctcttcatgctgggttacttccagctgctggagtgcgacctgccggcggaggagcggaagctgcgccacctgctgtgcttcgaggtcttcgagcacctgggcacccacggctgggaggctgtgcgcgccttccacaaggccgtgaccgacgaggtggccgccggccgccgggcctggaccgacggcttcgaggacatcaaagcccgcttctttggctccagccagcgtcccgcctgggatacggagcctggccgcaagtcaggtctgaccctgctcgggcccctgcctcacgccgccgtcccctgcagcggccctgagcccacagcacagcggctggggtcccgctcccagcagggcagcttcaacggtgaggacatctgcggctacatcaaccgcagctttgccttctggaaggagaaggaagctgagatgttcaactttggagaatgaccctactggcagcctgctttccagaatgtggtttgggggtgacttggagtttctcttttcttttccttgctcacacccttggtgttcaggtgagccgggcaaggctgcctccagtcctaccagttatcggaggctgcgggactgttctgttgtggcatggttctcctccgagctgggactcagactccttctcaccactgcacccaggaagccccttggcaggtcctgaagtgaggcaatgggccaccccagtccagggcacctctgcccagccggcccccgagacctgggatgctgcctgtttctcacttgtccttccccagtgtcaccagttcccttggcgtcctgtccctcagtttctgtggtgctggtggcctcggccacatccatctttcatgtgagtctgaggtggccccaggccctggtcctgcccctgtttctcctgctgaccttgggtcacaccccttcacctcccatctgtgaatttgggggagctggagtgattccgaggacagattccatgggcaggaggccttcctgccaggccatccctgctggtcacacaccgatgcccgccaggccagtgccccagcccagggtgctccggaggccctgcttcctcaaaggaggctccccatggggcccctgtcctccagcctgaccagccctggcctagtcgtgggccccagcaaggctggagagcagggacgtgggagtagcagtggctgagagagtcctccaggcagggtggctggtgcccactctcaaaggctgctgcacacagaggagaatgccggcaggggtgggcagcagccagacctcaggggggcgtggatactccgtgagggcacctgggtgtcacccacagtgcacctcttcacaggggcctgggtactggagggagggatacaggaagggagatggattccgtcctcgggggctctgggtgctgcggagtattcctgggcatggtgctgggcatggctggcatagggtgtggcttgtccccagcttctgatggcagccaggagaatgggtcatcacccaggctctggggctgaggagggctgggcccaagcccacagggactttggaggtggggctctgcagctgtgagatggcccagcagggagtggcagggacgggaggcttcaggaatattcctcctggcatccaggccccctgggacagaggagggtgcagtcaggcgacaggcttatcaggactccctgcctcaatccctggggattgtccaggcaaaacctggagggcagcgggcaagctgttggatggaacagagagaccctcgcagctgactagggcccaaggggacggacactcaagaagatgtaaaattgggaggggtggtattggccattggggcaggcagggccgggaagggaagtagcaccggccgcagccccaagccagtggcttttccacaagggcctatcctgcagccggcccgctccggcttcctccactgctgaagaccctgctgtagagctgaagctgaacatgtgtttgctaaataaagattcccattcctagcgc

SEQ ID NO: 130659 - DNA, 2339 bp, Homo sapiens
  Payload ID: 5546
  Gene Symbol: EME1
  Gene Name: essential meiotic structure-specific endonuclease 1
  Uniprot ID: Q96AY2
  ENST ID: ENST00000338165
  CDS Start-End: 83-1795
aggagatctacttccgggccctgcgtggcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggagcttggaggaagactaaa

SEQ ID NO: 130660 - DNA, 2354 bp, Homo sapiens
  Payload ID: 5546
  Gene Symbol: EME1
  Gene Name: essential meiotic structure-specific endonuclease 1
  Uniprot ID: Q96AY2
  ENST ID: ENST00000393271
  CDS Start-End: 83-1834
aggagatctacttccgggccctgcgtggcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggc

SEQ ID NO: 130661 - DNA, 2296 bp, Homo sapiens
  Payload ID: 5546
  Gene Symbol: EME1
  Gene Name: essential meiotic structure-specific endonuclease 1
  Uniprot ID: Q96AY2
  ENST ID: ENST00000511648
  CDS Start-End: 25-1776
ggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggc

SEQ ID NO: 130662 - DNA, 562 bp, Homo sapiens
  Payload ID: 5546
  Gene Symbol: EME1
  Gene Name: essential meiotic structure-specific endonuclease 1
  ENST ID: ENST00000511519
  CDS Start-End: 49-562
aaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacattgctcttacagatggaaggtgggggccagctcctaggagcactgcagaccatggagtgccgctgtgtgattgaggcgcaggctgtgccttgcagtgtcacttggaggagaagggctgggccgtctgagagaggactgggtggaggagccaacagtactggtgttgctccgggcagaggcatttgtgtccatgatcgacaatggaaagcag

SEQ ID NO: 130663 - DNA, 1010 bp, Homo sapiens
  Payload ID: 5546
  Gene Symbol: EME1
  Gene Name: essential meiotic structure-specific endonuclease 1
  ENST ID: ENST00000510246
  CDS Start-End: 1-1010
cctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgagggaagcctggacagcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatt

SEQ ID NO: 130664 - DNA, 679 bp, Homo sapiens
  Payload ID: 5546
  Gene Symbol: EME1
  Gene Name: essential meiotic structure-specific endonuclease 1
  ENST ID: ENST00000511711
  CDS Start-End: 61-366
gcgtggcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacataagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgag

SEQ ID NO: 130665 - DNA, 549 bp, Homo sapiens
  Payload ID: 5547
  Gene Symbol: EME2
  Gene Name: essential meiotic structure-specific endonuclease subunit 2
  ENST ID: ENST00000564182
  CDS Start-End: 1-346
ccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctggcctcccacaagacctggggctcagggcagccgcttccccacccagcacagcagcagaggggccctagagcccccacagaaaggactgtcccagcctcgggag

SEQ ID NO: 130666 - DNA, 1234 bp, Homo sapiens
  Payload ID: 5547
  Gene Symbol: EME2
  Gene Name: essential meiotic structure-specific endonuclease subunit 2
  Uniprot ID: A4GXA9
  ENST ID: ENST00000568449
  CDS Start-End: 22-1161
gaggaagaggtcggtccggccatggcgcgggttggacccgggagggcgggggtctcttgccagggccggggccggggacggggcgggagcggtcagcggcgacctccaacctgggagatctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcctgcctcctgaagtgtgggctgcaggtgaacaggaattgctgctgctgctggagcccgaggagtttctgcagggcgtcgccacactgacccagatctctggcccaacccactgggtgccctggatctcccccgagaccaccgcccggccccacctggctgtcatcgggctggatgcctacctgtggtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacc

SEQ ID NO: 130667 - DNA, 4586 bp, Homo sapiens
  Payload ID: 5547
  Gene Symbol: EME2
  Gene Name: essential meiotic structure-specific endonuclease subunit 2
  ENST ID: ENST00000561903
  CDS Start-End: 1-571
gtctcgccagcacgtttcccgggggacacagcagccagagagcccgaaggtggccggtgccgaggtggccgtcagctggccggaggtggaagaggccctggtactcctgcagctctgggcaaacctggacgtgctactggtggcctcttggcaggagctgagtcggcacgtgtgcgccgttaccaaggctctcgcccagtatcccctcaagcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctgaccacacgtgggaccaccaggacagcatgcagccttggggacagaccagacaccctgggcggtgggggaggacccccagccacatgtggaccctcagcctggtcctttaagtctatgacggcggggcagccgctgacagcatgcagagcaagttaggaaaaaccgaggccctgtgggaacagcaacgcgggctccagccaggctctcgtcctcgcagcctcccacaagacctggggctcagggcagccgcttccccacccagcacagcagcagaggggccctagagcccccacagaaaggactgtcccagcctcgggagcaagagatggctccctccggacgggcctcatccaactccgccctggagtgtggctggaaggaagggacagagaaagaagggacagaggaaaggggctgtcccagcccaagaaggcagttccactgggaagtcagtcaggtccggcggcagcgcttcctctggcagggccgaggctcgcgactgctggggtgggcggaggtcgctgcctggggatcggacactggagccttgcggcggctgcaactcatgctcaggacccagcccagcttgttgtgtagcacctgcttgaggcccggcggcagcggcagaccctccagcgtgtctcccgagtctggccgcagctggcgcaggcggtggcagcacaggtactggagggaagtggcgctggcacaggagcgggtgaccttcatgctgctccgggccgccgtggagcacaccatcggcggcagtccctgccccggtgggccgagtgcaggctgctacagaaggaggcctcgctctgcccagcacagtcacagaaggactcgccggtcacgggcaccgcactggggatggatggcggcagcgtggagtactcggggtcggagtccgagtcgctgtgctgggagagaagggccggctgttactacctgttgcccgctctctaccctctcacccttgccctctgtccctgtcccaccctgtccctgacccacccaggaaaggatgggggtccaggcctccagggacttcacagtaccccgagcgcacagcccaggctccctcccaacgggctccggctctgccccattctgcatgaccaggagggccctggaggcccagccacagagcagtagccaaggctgcctggcctccaagtggtttctagacggtggataagccccaggtccaccccacctgcccagagctgagatggtgtggacaccttccctgctaggccagccctgcaggggcccccaggcaaggccaccacccccacaccaggcccagctgcagccacccggcctcagggcagtccccaccacactgtggcccaacgaccttcctgttacctgagcagacctggctcaccacagggtcctactgcccagtgcccactacaggccccgcccctcctggtgcaggtttcagctgtcacctccctgaggcttctccagccccttcacccctgttccatttttcttcttttgcttcactgaagttctccttggtcctgattcttggcctcctcccaccagaacgtgagctccttgtgggaggcagtgcccctcccagcctcctccctgtcacagactgtgtgggggccacccaggggctgaatggaccagggggtcagcagggagagtgctaagtggtggcggggggcctgtggcagaggccttgtgacagtgagggttgagggctggtccagagagatgatgtgatccccaggagaagccacaggggaccatgacatgggcgccaccagcttccaggtgaacgtggacctatcgaaagccagcttcagggcaggacactgtcctttctggaggggatggccccaccccacagacaaggcaggcccagacaactctaccccactgcctagaagtgcgggtccccagagccagggtagaccccctgagtcaggagcccgggcacagaactgagcacctgcactgcaggcccagggccgggttccctggagaaggagaaagactgaagccactgcctacctcctgcccacaacagactgcaggcccatttggtgacacaggacaagcagcacatgtgtcgaacactgccgagcccgcaggcacgcctgcatcccacagccacgagcctgtgaggctcaggcatgtgacctgcaggagctggaggcgggcgggaaggcaggtgggggcctctccctggctggagcagggagctccaggagacctcaggacggcccccacccggtgggtaaggaccctgtttcccaatttgcccccaaggcctaatggacccaccgggcttagggagtcctcactcagaggagaggagcccacccctcccaggacacctggctgagccggaacagcagcgcaggggagctgtgacagcagagagcagcaccaggtcacacaagcagccgccccggaaggacacggcccatggtgacagaggacaagcagcatgcgtgtgtcagacactggcctggcctgtggacacgcccgcgtcccacagccatgaccctgcgaggccaggagagactgctccagggcacatgacctgtggtagctggaagtggggcagggaggcgcagccacactcctgctctggtccgagggagatctcaggaaaccgactgggaaatcaccccccacagggacccccacccctcccagcctcactgcgcccgtcaggccaggcagctgccctcagggtctgccaaggtgggggtcaggggccatgggggcaggtagctctgcctgcaaagcccacaagcatgtcagatcacctgggctgcagacagacaaacacctgagctgttctgaataccttcaggttcctggcctccctgagcaagtgcagaaatttttaccttcaaggatcagggtttttctgtttgtttgttttttaacacacatatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggctggaacgcactggtgtgatcacggctcactgcagccttgacctccctggctcaagcaatcctcccagctcagcctcctgagtcgttgggactacaggcacgtgccaccacgcctgacacattttttaaatttttgtagagacagtgtttcaccatgttgcccaggcaggtctcaaactcctgggctcaagtggtcctccagcttcagcctcccaaagtgctaggattataggtgtgagccacagtgcccagccccgtagtggagaatttctgttgaatgaaccaaaagcaactgccaacctctccatgcaccatgtgtttcagaggagaaagcacagtgaagaatgcagtgtgttctgaggtcctgtcacccctgaggctgtgtgtgtcctttgccaaattaaagagtcttactgaatgcggtgcatccaggagacaggcccaggtttggactggtcctctagcctcagaagcatctttttctccgactgattccgtgttcaggtaatgtctgcctgcctgcctagggcatctccacaccttaggccagccacgtccgcctcgcccgctggaacctacctgcccatcagagtcgtagccccagttagtggagcctgctagagccacggcccgggcatctgcgtctcggcgggctgcactcaggacgaagtgccaggccctgctgttccgggggcgtctggccatggtggaaagaatctagaagaaaacacaggctctgggcaaaggaagactcacagcactcccagccctgagcttccaggctgggccacggacccactcaaagtggggactgcaggggccgcaccggtgcccagccagggctccagaacgcttcaggagcccgtacctcactccaggatctgagcagctcaataaaacccaggtagatcctgtgaaacgccacccaga

SEQ ID NO: 130668 - DNA, 4523 bp, Homo sapiens
  Payload ID: 5548
  Gene Symbol: ESCO1
  Gene Name: establishment of sister chromatid cohesion N-acetyltransferase 1
  Uniprot ID: Q5FWF5
  ENST ID: ENST00000269214
  CDS Start-End: 939-3461
gtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacgtttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaa

SEQ ID NO: 130669 - DNA, 4773 bp, Homo sapiens
  Payload ID: 5548
  Gene Symbol: ESCO1
  Gene Name: establishment of sister chromatid cohesion N-acetyltransferase 1
  Uniprot ID: Q5FWF5
  ENST ID: ENST00000383276
  CDS Start-End: 1087-3192
agtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacgtttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtggttctgctcattaatcaccacgagtgtggatctgaagaagagtttattacctctctttttttgagtatgtttaacttcagatacacacaacgtagcttctccttccctattagattcttagaagggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaag

SEQ ID NO: 130670 - DNA, 1850 bp, Homo sapiens
  Payload ID: 5548
  Gene Symbol: ESCO1
  Gene Name: establishment of sister chromatid cohesion N-acetyltransferase 1
  ENST ID: ENST00000622333
  CDS Start-End: 299-817
caaaaaagatttggagcagtttcttgtaatgtttgtggaatgctgtatacagcttcaaatccagaagatgaaacacagcatctgcttttccacaaccagtttataagtgctgttaaatatgtggttctgctcattaatcaccacgagtgtggatctgaagaagagtttattacctctctttttttgagtatgtttaacttcagatacacacaacgtagcttctccttccctattagattcttagaagggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagcttt

SEQ ID NO: 130671 - DNA, 3922 bp, Homo sapiens
  Payload ID: 5549
  Gene Symbol: ESCO2
  Gene Name: establishment of sister chromatid cohesion N-acetyltransferase 2
  Uniprot ID: Q56NI9
  ENST ID: ENST00000305188
  CDS Start-End: 239-2044
agatttttcacctcaccagggcgcgagaatcttggaaacagccaccagggtgggcggggcaagggctggtgctccaccaatcaccgagccagcccctggaagcgctgagccgtggccaatcggaacgcagcggcttcctcctagcctggcgcgcgattatttgaagacgctcacggagcggctggctaggctgaggagagctcgccgggctctgaggcgcaggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaaggattcatcagatgacagagtttcttcaaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacgcacacacacatatcacagttttgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcgagcttgcagtgagccgagattgcgccactgcagtccgcagtccggcctgggcgacagagcgagactccgtctcaaaaaaaaaaaaaaaaaaaaaaaaaaaaa

SEQ ID NO: 130672 - DNA, 720 bp, Homo sapiens
  Payload ID: 5549
  Gene Symbol: ESCO2
  Gene Name: establishment of sister chromatid cohesion N-acetyltransferase 2
  Uniprot ID: Q56NI9
  ENST ID: ENST00000397418
  CDS Start-End: 1-720
atgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatgattgtagaagattaaataggtaccaggagacatga

SEQ ID NO: 130673 - DNA, 574 bp, Homo sapiens
  Payload ID: 5549
  Gene Symbol: ESCO2
  Gene Name: establishment of sister chromatid cohesion N-acetyltransferase 2
  ENST ID: ENST00000519637
  CDS Start-End: 176-574
gtggaacgtgggggcgaatgtcacggggaaagagcttttgctcggcgctcggcaggtccgcaggcccgagaccgaagaagccactgactcgttctccgcgctcacaggcgccgggtttccctcttcccgacgccggcgtttccttgttttgggtttagggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctcc

SEQ ID NO: 130674 - DNA, 698 bp, Homo sapiens
  Payload ID: 5549
  Gene Symbol: ESCO2
  Gene Name: establishment of sister chromatid cohesion N-acetyltransferase 2
  ENST ID: ENST00000523566
  CDS Start-End: 137-698
accataggtcacttctgagatctgggacatcaactgcccggagagtggctgggtggacatcccagggtctttttattgttttctgttgcatcccagaccctacaaccccttcctgaaagggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaata

SEQ ID NO: 130675 - DNA, 2503 bp, Homo sapiens
  Payload ID: 5549
  Gene Symbol: ESCO2
  Gene Name: establishment of sister chromatid cohesion N-acetyltransferase 2
  ENST ID: ENST00000522378
  CDS Start-End: 71-943
gctcacggagcggctggctaggctgaggagagctcgccgggctctgaggcgcaggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatgattgtagaagattaaataggtaccaggagacatgaaagaatcatcttcaacatttctcaagtagctgctgattatctccttttatggaggcataacaagctcctggaggcttctacagattctaaagggaaagatttcctgggaggttggtaaatattcaagaagctggtcagttggcagctgttttatagattccttgggattttctacctaaacaacatatcaactgcaaacggggacagtttcgtctcctttccaattttgccttctccattttcttgccttattttagtggctagggctataggactgctaaataaaactggcaagagcaggcatcctggtcttgttccctacttcagtatgatacctgcaggtttttcttgtagacagcctttttcaagctaagatcccttctatttctagttagctgagaggttaactagattttaaactaacttttaaatcaagaatggatgttggattttgtcaaacactttttcggtatctattgagatatgtagttttcaaatttgattaaagacttaaatgttggacctaaaaccataaaaaccctagaagaaaacctaggcaataccattcaggacataggcatgggcaacgacttcatgattaaaacaccaaaagcaatggcagcaaaagccaaaacagacaaatgggatctaattaaagagcttctgcacagcaaaagaaagtaccatcaaagtgaacaggcaacctacagaatgggagaacatttttgcaatcgacctatctgacaaagggctaatatccagaatctacaaagaactcaaacaaatttacaagaaaaaaaaaaaaaaaa

SEQ ID NO: 130676 - DNA, 528 bp, Homo sapiens
  Payload ID: 5549
  Gene Symbol: ESCO2
  Gene Name: establishment of sister chromatid cohesion N-acetyltransferase 2
  ENST ID: ENST00000518262
  CDS Start-End: 1-528
caaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggcatttcgtgtcctgtctgaaccaattggtccagaatccccaagctctacggaatgtccta

SEQ ID NO: 130677 - DNA, 1079 bp, Homo sapiens
  Payload ID: 5550
  Gene Symbol: ESD
  Gene Name: esterase D
  ENST ID: ENST00000378697
  CDS Start-End: 237-998
cgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacaggagatagatctgagagtgtcccagctttatggactgcctcttcctaactctgggaaagattggagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagggttatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaa

SEQ ID NO: 130678 - DNA, 1192 bp, Homo sapiens
  Payload ID: 5550
  Gene Symbol: ESD
  Gene Name: esterase D
  Uniprot ID: P10768
  ENST ID: ENST00000378720
  CDS Start-End: 184-1032
aaagcgagagtgagtgggaccggaggggcggggcatcatatgggcggggctgaggcgaggccccggcggccatcttgagccccgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagggttatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaattcaaaacattggattttatagtgctaaaagggctttattctatagttgaatcacctctgaataaagatataaaaccta

SEQ ID NO: 130679 - DNA, 921 bp, Homo sapiens
  Payload ID: 5550
  Gene Symbol: ESD
  Gene Name: esterase D
  ENST ID: ENST00000412582
  CDS Start-End: 1-692
gtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagcatggtcgggttaagagtggactacatagcttgaagcggatttcgttgagattcgttgtaattgaatcaacaactgaatgagcatgcctaagtagtggctccagagagtctgctttcagattttcttgccagctttgacccaagattaccctgggtctgcgagttttatcacctgctttatcatttgattacaagtatagtataactgtatttccttgtgggatagaagctgtaaaaaataagctgaaaataataggggatatatataaataaacgatctgagaaagaataaagaaaataattacaatca

SEQ ID NO: 130680 - DNA, 2410 bp, Homo sapiens
  Payload ID: 5550
  Gene Symbol: ESD
  Gene Name: esterase D
  ENST ID: ENST00000471867
  CDS Start-End: 1-361
gtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagaggcaagtattaggaaactttagcttgatctagataatgtaactatgaaaaattaggattctgtgatattttcttaactttattttagaatataaaatgctacttctagtaagtttttaattatattcagacacttgaagtgaaaacctgcctataaaattaattatatctaacactaaatttgatagaaataggaaagcttttggcagtgaaaaatattgttttccatcaaaccagtaaataacaagatttttaatgcttgaatgatgattaatcttcagcattagcagatacttctttctttacacatggacctttgctgcagtagaataaaaaggacaaacttctacctaaattactccttattttatgtatatattttagcctcagaagttaagtattatttatcacacatgtgctttatattatttgactttcatattaatctattcattgtgctacttgatatttctagttgtttaagaataattactgaatcccaatgggcttgcaagttttttttaactaaaatatttttgaccgtccactactcacctaactctatatatgctaccatagtcctaattaaggaagttctgcttttatttttaagaaaaattcataagcttcagaatataatttaaaatattttagagtgaaaaatgagcactgaaaattatacatggtcatgatttttaaataaatttttatccatgtttaaggataatgtgtcaggcacattgatctaaaatgtaattacgatggtaaatgttcaaatctagatcagtgtgtaatgtggtacattagtttgtaaaatgctttcacagcattaactcattgttaattcttataccgccaaatgagatatcatttctttcctatccatctgttttacaaatgaggagacaggctcagagaagtaacctacttatctaaggccacatagctagtaagtggtggaaccagaactggaactaaggccatttaactgcaaatactgacctcctgtcatttatcaagccattttcagacggcatgatattctcctgaggagcaaaggaatggaattagagctagcacaaggagaaattgtgcatagcttgctgcctacgtaacttatgcagaagatctgagcagtcttcctgtttttagggatattttgcacatgtgaactatatagtgagaaaatgtcaaaaactaatacatgatatactgtttgtctcttagtgtccatccttgagtaatagaattttgttttagatttatttgaacatttaccatcacaattaaattttaggtcaacaaccagccttgagaaatccaaataccaatttgactataaatatagtaatacgtttaactgcaataactatagctataagtgcgtaccaaaccatgttttttccaaatgaccttaatttcttggcactacccatgttggatacctcatttgcttccccaaagactgggcccaaaatttctgttgtttctacaatgattctgcctgccaacaaagtctgaaaatctcaagtttgttataaaaacagcacagttagaacatgatgacattcctggagggaaaaataagtccacttatttgtttctaaaatgcctgtatcccaagcaactagaacacatagttggctatacttaatgaggagtcaagacaaaccattcaattcttctaaaaaagtaagaaagtattcaaagcaccagagtcacaatgttgagctcaggtgcaattttctattcactttacttccagcatggtcgggttaagagtggactacatagcttgaagcggatttcgttgagattcgttgtaattgaatcaacaactgaatgagcatgcctaagtagtggctccagagagtctgctttcagattttcttgccagctttgacccaagattaccctgggtctgcgagttttatcacctgctttatcatttgattacaagtatagtataactgtatttccttgtgggatagaagctgtaaaaaataagctgaaaataataggggatatatataaataaacgatctgagaaagaataaagaaaataattacaa

SEQ ID NO: 130681 - DNA, 6458 bp, Homo sapiens
  Payload ID: 5551
  Gene Symbol: ESR1
  Gene Name: estrogen receptor 1
  Uniprot ID: P03372
  ENST ID: ENST00000206249
  CDS Start-End: 363-2150
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 130682 - DNA, 3335 bp, Homo sapiens
  Payload ID: 5551
  Gene Symbol: ESR1
  Gene Name: estrogen receptor 1
  Uniprot ID: P03372
  ENST ID: ENST00000338799
  CDS Start-End: 1461-3248
ctagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttcttttttgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtggaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgc

SEQ ID NO: 130683 - DNA, 1251 bp, Homo sapiens
  Payload ID: 5551
  Gene Symbol: ESR1
  Gene Name: estrogen receptor 1
  ENST ID: ENST00000406599
  CDS Start-End: 235-1239
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggc

SEQ ID NO: 130684 - DNA, 624 bp, Homo sapiens
  Payload ID: 5551
  Gene Symbol: ESR1
  Gene Name: estrogen receptor 1
  ENST ID: ENST00000404742
  CDS Start-End: 371-624
atggtcataacagcctcctgtctaccgactcagaacggattttaccaaaactgaaaatgcaggctccatgctcagaagctctttaacaggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctga

SEQ ID NO: 130685 - DNA, 6357 bp, Homo sapiens
  Payload ID: 5551
  Gene Symbol: ESR1
  Gene Name: estrogen receptor 1
  Uniprot ID: P03372
  ENST ID: ENST00000443427
  CDS Start-End: 262-2049
gacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 130686 - DNA, 5436 bp, Homo sapiens
  Payload ID: 5551
  Gene Symbol: ESR1
  Gene Name: estrogen receptor 1
  ENST ID: ENST00000427531
  CDS Start-End: 233-1165
gcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaaggaaatgaaaagaaaaaaaa

SEQ ID NO: 130687 - DNA, 323 bp, Homo sapiens
  Payload ID: 5551
  Gene Symbol: ESR1
  Gene Name: estrogen receptor 1
  ENST ID: ENST00000415488
  CDS Start-End: 1-323
cataacgactatatgtgtccagccaccaaccagtgcaccattgataaaaacaggaggaagagctgccaggcctgccggctccgtaaatgctacgaagtgggaatgatgaaaggtggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggtt

SEQ ID NO: 130688 - DNA, 6466 bp, Homo sapiens
  Payload ID: 5551
  Gene Symbol: ESR1
  Gene Name: estrogen receptor 1
  Uniprot ID: P03372
  ENST ID: ENST00000440973
  CDS Start-End: 371-2158
atggtcataacagcctcctgtctaccgactcagaacggattttaccaaaactgaaaatgcaggctccatgctcagaagctctttaacaggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 130689 - DNA, 731 bp, Homo sapiens
  Payload ID: 5551
  Gene Symbol: ESR1
  Gene Name: estrogen receptor 1
  ENST ID: ENST00000446550
  CDS Start-End: 385-731
atgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgca

SEQ ID NO: 130690 - DNA, 1368 bp, Homo sapiens
  Payload ID: 5551
  Gene Symbol: ESR1
  Gene Name: estrogen receptor 1
  ENST ID: ENST00000456483
  CDS Start-End: 235-693
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggacataacgactatatgtgtccagccaccaaccagtgcaccattgataaaaacaggaggaagagctgccaggcctgccggctccgtaaatgctacgaagtgggaatgatgaaaggtggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggc

SEQ ID NO: 130691 - DNA, 1518 bp, Homo sapiens
  Payload ID: 5552
  Gene Symbol: ESR2
  Gene Name: estrogen receptor 2 (ER beta)
  Uniprot ID: Q92731
  ENST ID: ENST00000267525
  CDS Start-End: 91-1410
ccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttgg

SEQ ID NO: 130692 - DNA, 2454 bp, Homo sapiens
  Payload ID: 5552
  Gene Symbol: ESR2
  Gene Name: estrogen receptor 2 (ER beta)
  Uniprot ID: Q92731
  ENST ID: ENST00000353772
  CDS Start-End: 469-1956
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggc

SEQ ID NO: 130693 - DNA, 2060 bp, Homo sapiens
  Payload ID: 5552
  Gene Symbol: ESR2
  Gene Name: estrogen receptor 2 (ER beta)
  Uniprot ID: Q92731
  ENST ID: ENST00000341099
  CDS Start-End: 419-2011
tttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgt

SEQ ID NO: 130694 - DNA, 1427 bp, Homo sapiens
  Payload ID: 5552
  Gene Symbol: ESR2
  Gene Name: estrogen receptor 2 (ER beta)
  Uniprot ID: Q92731
  ENST ID: ENST00000344288
  CDS Start-End: 52-1023
gacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccgggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaag

SEQ ID NO: 130695 - DNA, 1899 bp, Homo sapiens
  Payload ID: 5552
  Gene Symbol: ESR2
  Gene Name: estrogen receptor 2 (ER beta)
  Uniprot ID: Q92731
  ENST ID: ENST00000358599
  CDS Start-End: 306-1793
gatgccagttaactgtcgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaag

SEQ ID NO: 130696 - DNA, 1883 bp, Homo sapiens
  Payload ID: 5552
  Gene Symbol: ESR2
  Gene Name: estrogen receptor 2 (ER beta)
  Uniprot ID: Q92731
  ENST ID: ENST00000555278
  CDS Start-End: 1-1446
atggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagatggggagaaaagcaattcattcatttgaagttatcttagtgccaagagtcatgtgaaaatgtcccttgcatgtgggcaatgaaagatttgcagacgatataaaacccagactacctcataaaagagttttgggaatacactgagctttgagtgaaagaagctgcagtggcctccctggagatggggagcaaaccagcttaaaggcccttatcctgaggaagagacaaaaattgacatgcacaatattaagctttgaaatgcagaccacacttcctttcactgcaactttgacttgtcccgcatctctacttaagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatc

SEQ ID NO: 130697 - DNA, 3588 bp, Homo sapiens
  Payload ID: 5552
  Gene Symbol: ESR2
  Gene Name: estrogen receptor 2 (ER beta)
  Uniprot ID: Q92731
  ENST ID: ENST00000554572
  CDS Start-End: 1275-2762
cgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagacatccaagtggagatatggcatttaaattcatgagattggatgagatcccaccaaaggaacaggtttaggtggagacaaccaaataccgatgcctaggacactgcagtgtttagaattcaaggagatgagaaggaaacaggagggaagattgaaaagaagagtccagtgtgttatgaggaaaaccccaagagcatgctgccttacaagacaggtgaaaaatgtgttctgtgaaagaaagagtaattaactgttaaatgttacagactgatcaaataaaatgaagactgagaatggcctgtttgtaagagggagacatcaacctgttgtggaaaagaatgatcacttaaagtctttagaaattctgaaccaactctctagcaggtgatccttgttagaatttgagcccttaacgctatccaggactggaggttgaagggacgatagagggagcaggaggagaatgcacatggattaaggagcgagaacacagaaatcctgggctctcttctcccagccacaaggttaggttgaaaaacagagcagatggaggtagtttgtagcctacaggtgccctgaatgaagcttccacagtgctaaagtggaagaacgagggactccaagggaaggattcaaggctgggcccatgcacctgtgtaattcagaagagaccccagaggagatcagcgccctctaattagccctgtatctgggctctacaggacagacatgcctccatttatgcaacaaataagaacagcatctcatgacagtggagaaaacatgggatgtgcaggtagggttttgttttgcctcttggtagtttctttcctacggaaaattctccctctgatctttccaagtcaaaggcttcagcaaacatttgttgaacgcgtggattgtgctaggtgggtgttatggaccatggagaatgctagagatgtaagacatgcgctgtccaatcgcagcgcaggttgtgttgacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagactctgtc

SEQ ID NO: 130698 - DNA, 5458 bp, Homo sapiens
  Payload ID: 5552
  Gene Symbol: ESR2
  Gene Name: estrogen receptor 2 (ER beta)
  Uniprot ID: Q92731
  ENST ID: ENST00000557772
  CDS Start-End: 1-1419
atggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgaggtacgcgccctaaggagctgctctgcttgggcttgggatgggattatgtgctccacggagggtgaagtgatttgggaaaagtgtctgcaagttaaggaaaatgaatgcctgaaagggaatggggaatttgtcagttcacacacctgtaagcaaagatgggcacagagtgggcatggaaggaatgtcatgtggtatcttacaggctctgcatggcagccagtggtggctcatgggtttttcaattgctggggtttatagcctgtttatggagtcctaaaaggggcagttcctcccctaacacgaactgccacccctgtttacaccacccagggctgaggccctgaggccactttttgtggagaggctaagacccgctcccctagatggcccctcgagctggtgatgcgaagaagtgcacaaatgcttccctaagagttgttctttcggtggcatcaggaaattaaggataagacttaagagaagtggtggacccagcagatttaggaaggcagggctgtaggtagggcatgtttctgatcaggaaacgtaattgtgtgtgctgatgaagagggtgtgcagtggtggctactgttggtacaatgatgctcagtgcttggtgtcacccacgatgagggtagccttgccctggagctggaggaggggaggggagggtggaaggtaattaactggtcactgaggaggcaagtctagaggctgtggagaaggacaatatacacctcgagaatcttaagtgagatgaagacctctgcctttcccctttaatgattgctcagcacatagccatttgcagaacagatcctgtgtttgtagattccttcattgtgaatttatctgcttgctaaaatttatttgtaaccccaaaatcaatatttgtggtgtttttgaggtcatgaacagagtggcagaaattttgagttgccctttatgtacagtcccagctgagatggaacaagcagctgctctcatactgtcaacaagtgtcctttacttggtctacttagtgccatggttttacatttttgtgcttttggtgacttcactgtttaaaatgcccccctggtgtggtgctgaagacctgtctagtgttcctcggtgtgaaaaagctgtgatgtgccttatggagaaagtatgtgttaagctttgctcgggtgtgagttatagtgctgctggccatgagttcaatgttaatgagtcaatggtatttatcacataaggcatctttagaaagaaacacacataaaacaaggttttgtattgatcagctgatgaagatgtggccagaggcttgcaggaacctaaccctgtatttcccctatgagtgaggattcagtgttcacagtgactttacggaacataattaccgcaaacaatgaggattgattgtcctatgtgtcaggccattgtaggtgtgtggtgggacacagaggctgacaagacatcgtccttgcccttgagcctaaattatcagggggagctggatgcacgagccatggataaatgggctgggggaagagtgggtttaggggtggggtagactggctctgagcaaagagagccggggaaggcttcggggttcctgtggctgcctcggaggagggaatctcagcacctttttgtccccatagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttggtgatggcaggcttggtcatgtaccatccttccctccaccttcccaactctcaggagtcggtgtgaggaagccatagtttcccttgttagcagagggcacatttgaatgcagcgtttccacactcaatggcctcataggatctcagtgtggtctttcttactttccttcttccttcctcccctttgtgaaacatcttaaaggttttggaatgaatggtggaaatctgacttggaagggctgcgaatcagaaaggggagaggaagtgacacgcttacagaagtgggctaacccttcttgtgtggcacacactacccttccctctgagagttgacctttgctgttttccggaccactccattgtaagattgaaaacccctgtggcaattgcgtacttacctcccaggcctgtggggactgatcatatcatatgatgcttattctgtcaaaggccagagggactgtggttaagctgggatgtgagtcatgttctctccctgaccttgctgccagctgcacacagatttgtccctctcgatttgtattcacagagcctgccaataatttggggtatgtgtgtatgagcgtgtgatcattttcatgcaggactgtgggagatacaaatctcgctgcttctggagctgctcttccttaaacctgttgtcccatggggccagcgtgggtgctggagaaaggccgtgtttgcaggaatggggttctctcctgtgggtgtgggtgacagccacagtgtttccctggggcaatgtggatgcagtttccatcttgtacaacctcataagtagcagccacaattgccccatcagtcaccacaagtagtcagggatactttgggctgtggatgtgtgcagtgtgctgttttatggatggatgagtagctatgcaccccagtgtgtcagctctggggccacactgtatagccttgatgagtacgccccttgaacaagacccagtttgtgaactctccttaaagagaaatatttagggataattatttatagcaagaaagaattcttttacacttgagagctcttttaaaaatattttcttattggaaaatttatatggtgggcagggtgaaaaagaaacagtaaaaatattagttcttattccaagtggaacataaataggacatgaagaagggcacctctgaaatgacaactttaactcaccttttaaaagatgtgaaatttccagttttggatacacggtgaatatgtaaaatgagtaacagcatactatggaagccagcaattaaataatcatgtttcattattgcagtaacgttttaaacaattaccttgtgatatgatattaaatatattttctttttgaaaatatgttcactttgggtagcacatcctgtatttactaagtcattaggaagactgcattcagtgttaccaagactggtttttgctagtaagacctcgaataatccataattttgatattggtgcaattttactataagttgagcttagctgtttcagaaatgcttggacaagtacctagagaacacactgatgtctgtgttctgaggcagtctgaagttattcttagagactcagttacagctttagtaagatttagtacaggcaggataagcttggtttcataggaaccagggaaccagtgttagtgtcagcttctttcctcctggtcagcctagaatcccccactcccaatagaggggtttggaagctggagagtaggaagtaagaggcaaagaaggcagccttcagcaactcattatctgccagtgaaattctattaaatgtatttttaaaagagattaccaggtaacaaaaacataaaaaaccaaaacaaggccagatgtggtggctcacgcctgtaatcccagcactttgggaggccgaggtgggcgaaccacttgagcccatgagtttgactccaggctgggcaacatggaaaccctgtcctacaaaagatacaaaaattagccaggcgtggtggtgcaggcctgtagttccagctacctgggaggctgaggtgggaggatcacctgagcctggggagatcaaggctgcagtccattgcactccagcctgggtgacagagggagaccctgtctc

SEQ ID NO: 130699 - DNA, 1634 bp, Homo sapiens
  Payload ID: 5552
  Gene Symbol: ESR2
  Gene Name: estrogen receptor 2 (ER beta)
  Uniprot ID: Q92731
  ENST ID: ENST00000553796
  CDS Start-End: 1-1425
atggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgaggtcctgtgtatacaagtaaaatgcagctcacaaaagtcctggtatccagtgcatcgattatttggatagattttctgtaatcattctgagtttgattagaattatatcctttacagatggggagaaaagcaattcattcatttgaagttatcttagtgccaagagtcatgtgaaaatgtcccttgcatgtgggcaatgaaagatttgcagacgatataaaacccagac

SEQ ID NO: 130700 - DNA, 2695 bp, Homo sapiens
  Payload ID: 5552
  Gene Symbol: ESR2
  Gene Name: estrogen receptor 2 (ER beta)
  ENST ID: ENST00000556275
  CDS Start-End: 469-2010
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagctctctctcactctcttggagattgtttatgctgagggaagccagctgccatggtgtgaggcagactcctggaggagcccacgtgtctgtaagtagaagcagatcttttgaggcctgtcaacagccacgggaatgagcttggaagcagatcccacctcctccctcacacaagtcgagccttcagatgagcctgcagcctttgtcgacaccttgaccgcattctcatgagagaccttgagccagagatacttagctaagccatgcccatggactcctgacccacagaaactgtgataataagtttgttgtttcaagctgctaacttatggagtaatatgttacacaaaaatagctaatatatagctcaaaactggaagcaacccaaatatctattaactggtagataaacaaactactcatttccaaacttatttccaaaactggaacactacttggcaatcaaataattaactatgcattaagtgtaacaacctggatgaatctcaaaggcattatgttaagtgaaacaagtgagccacgtaagactacatactgtttgattccctctatatgatattctagaaaaggcaaaactatagtaataggaaacagtgagtgatcacctagggttgaagacaggtgaaaggggattgactgcaaagaggcaggaggaaacgtcttgggagatggagatgttccttatattgatggcggtggtggttacacaactgcacttttatcaaaacttacctaactgctacttaaaataggtgtattaatatttttactgtatgtaaattatacctcaataaatttgattt

SEQ ID NO: 130701 - DNA, 2379 bp, Homo sapiens
  Payload ID: 5553
  Gene Symbol: EBAG9
  Gene Name: estrogen receptor binding site associated, antigen, 9
  Uniprot ID: O00559
  ENST ID: ENST00000337573
  CDS Start-End: 301-942
gtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaacttaaatagaa

SEQ ID NO: 130702 - DNA, 1467 bp, Homo sapiens
  Payload ID: 5553
  Gene Symbol: EBAG9
  Gene Name: estrogen receptor binding site associated, antigen, 9
  Uniprot ID: O00559
  ENST ID: ENST00000395785
  CDS Start-End: 225-866
gatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcat

SEQ ID NO: 130703 - DNA, 777 bp, Homo sapiens
  Payload ID: 5553
  Gene Symbol: EBAG9
  Gene Name: estrogen receptor binding site associated, antigen, 9
  Uniprot ID: O00559
  ENST ID: ENST00000531677
  CDS Start-End: 1-777
atggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagatccaggaccaatgtatgtttactctgctctctcctgtttcatcatcccactcctacctccactccctacattaaccaatcagtaaagatagagagagtgagtctgggtcagtggagttacggaaagagtaaggaacagcagaaactagcagacagagaaaagagagcagccgaacaacaaaggaagaaaatggaaaaggaagcacaacggctaatgaagaaggaacaaaacaaaattggtgtgaaactttcataa

SEQ ID NO: 130704 - DNA, 706 bp, Homo sapiens
  Payload ID: 5553
  Gene Symbol: EBAG9
  Gene Name: estrogen receptor binding site associated, antigen, 9
  ENST ID: ENST00000530629
  CDS Start-End: 116-706
atggcacagaatgttcgattttactaccagctctcacactccgcttctgtttccccttctcttacgggccgctgctcaaacctttatttatcaaatttaagttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagca

SEQ ID NO: 130705 - DNA, 413 bp, Homo sapiens
  Payload ID: 5553
  Gene Symbol: EBAG9
  Gene Name: estrogen receptor binding site associated, antigen, 9
  ENST ID: ENST00000529931
  CDS Start-End: 291-413
gcgcgtgagcgcgccttgtgtgcgcgcgcggcccgcggcagctcggagcctccgccgggcgggcggggagggggaggggcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgcct

SEQ ID NO: 130706 - DNA, 813 bp, Homo sapiens
  Payload ID: 5553
  Gene Symbol: EBAG9
  Gene Name: estrogen receptor binding site associated, antigen, 9
  ENST ID: ENST00000534318
  CDS Start-End: 579-813
ggtactcctaggtattggcatttctttaatagattcccagatttgtgaaccactggactaaatgagctccatggtaactttcaatttactagctatgtgactttggtcaagttatttgacctctcttaattcaatttcctcatctataaaatggatataaggaaatatattcatctgcaagttaaaaatatttaaagtattttaaatagtattatgttcatgtggttcaaactttaaaaggtacacagagatttaatatattctattttatacttttttattttttgaattgtagatttttgtattaatagatttaggtaaaattattttcaaaaactcagaatgaagggttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatggga

SEQ ID NO: 130707 - DNA, 939 bp, Homo sapiens
  Payload ID: 5553
  Gene Symbol: EBAG9
  Gene Name: estrogen receptor binding site associated, antigen, 9
  ENST ID: ENST00000527709
  CDS Start-End: 293-754
ttcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtctacaagtcattgggttggggctacaatcatctgaaggcttgattgtggtcgaaggattcatttcaaagacagctcacttctacacctgacaaattaatgctatttgtttgcacaaagcctcagttccttgctgtgcacctctccaaggagctgcttgaatttctttatgatgtaactcctgattttcccatctgaattaggtgacttagatacctggca

SEQ ID NO: 130708 - DNA, 2186 bp, Homo sapiens
  Payload ID: 5553
  Gene Symbol: EBAG9
  Gene Name: estrogen receptor binding site associated, antigen, 9
  Uniprot ID: O00559
  ENST ID: ENST00000620557
  CDS Start-End: 116-757
atggcacagaatgttcgattttactaccagctctcacactccgcttctgtttccccttctcttacgggccgctgctcaaacctttatttatcaaatttaagttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaactt

SEQ ID NO: 130709 - DNA, 1179 bp, Homo sapiens
  Payload ID: 5553
  Gene Symbol: EBAG9
  Gene Name: estrogen receptor binding site associated, antigen, 9
  Uniprot ID: O00559
  ENST ID: ENST00000614147
  CDS Start-End: 403-1179
ccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagatccaggaccaatgtatgtttactctgctctctcctgtttcatcatcccactcctacctccactccctacattaaccaatcagtaaagatagagagagtgagtctgggtcagtggagttacggaaagagtaaggaacagcagaaactagcagacagagaaaagagagcagccgaacaacaaaggaagaaaatggaaaaggaagcacaacggctaatgaagaaggaacaaaacaaaattggtgtgaaactttcataa

SEQ ID NO: 130710 - DNA, 2215 bp, Homo sapiens
  Payload ID: 5554
  Gene Symbol: ESRRA
  Gene Name: estrogen-related receptor alpha
  Uniprot ID: P11474
  ENST ID: ENST00000000442
  CDS Start-End: 172-1443
aagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 130711 - DNA, 2283 bp, Homo sapiens
  Payload ID: 5554
  Gene Symbol: ESRRA
  Gene Name: estrogen-related receptor alpha
  Uniprot ID: P11474
  ENST ID: ENST00000405666
  CDS Start-End: 235-1506
tagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctcaaaaa

SEQ ID NO: 130712 - DNA, 2218 bp, Homo sapiens
  Payload ID: 5554
  Gene Symbol: ESRRA
  Gene Name: estrogen-related receptor alpha
  Uniprot ID: P11474
  ENST ID: ENST00000406310
  CDS Start-End: 178-1446
tcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 130713 - DNA, 747 bp, Homo sapiens
  Payload ID: 5554
  Gene Symbol: ESRRA
  Gene Name: estrogen-related receptor alpha
  ENST ID: ENST00000539594
  CDS Start-End: 262-747
gcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactg

SEQ ID NO: 130714 - DNA, 742 bp, Homo sapiens
  Payload ID: 5554
  Gene Symbol: ESRRA
  Gene Name: estrogen-related receptor alpha
  ENST ID: ENST00000468670
  CDS Start-End: 414-742
caggtgtgaaaagctctggaggtgttttcatgagtccgtgcctgtgcgtgtggatgtggggagacctagtgagagtgtgtgtgatcatgagccttgactgagttcgtggatggggtgtgcgctccaggagaagtgtgtgagcacaagtgtgagcaggagtgagcacgggtttgggaaggccggtgcaagtgtgaaagccctcagcagagagcgagcctgcgtgggcttgtggggctcctgagcaccccggtgagtggagtgtgtgaactcggtgtgagcacgtccactggccttgggtctgctctccaatgcagaatacccagatgagggcagggtctcagaggtccccccaacatctggagaaaactgggaagtatcctgctcctggctagggattccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggtga

SEQ ID NO: 130715 - DNA, 677 bp, Homo sapiens
  Payload ID: 5554
  Gene Symbol: ESRRA
  Gene Name: estrogen-related receptor alpha
  ENST ID: ENST00000545035
  CDS Start-End: 1-593
ggcggccggaggtggacccactgcccttcccgggccccttccctgctgggcccctggcagtcgctggaggcccccggaagacaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagg

SEQ ID NO: 130716 - DNA, 2745 bp, Homo sapiens
  Payload ID: 5555
  Gene Symbol: ESRRB
  Gene Name: estrogen-related receptor beta
  Uniprot ID: O95718
  ENST ID: ENST00000380887
  CDS Start-End: 99-1625
tccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaactat

SEQ ID NO: 130717 - DNA, 2849 bp, Homo sapiens
  Payload ID: 5555
  Gene Symbol: ESRRB
  Gene Name: estrogen-related receptor beta
  Uniprot ID: O95718
  ENST ID: ENST00000509242
  CDS Start-End: 209-1735
ccctctccatgtttgagggccgaagagcctgcatcgagcagagccaccaggctaaatcctctgaccttgactttggtttagggaccagagtctggtatctaagtgcgatcttactctagctttcccatctgttctgtttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaagg

SEQ ID NO: 130718 - DNA, 2432 bp, Homo sapiens
  Payload ID: 5555
  Gene Symbol: ESRRB
  Gene Name: estrogen-related receptor beta
  Uniprot ID: O95718
  ENST ID: ENST00000505752
  CDS Start-End: 575-2077
ttcaggaaaagccatcatgtttccgcagcatttatctgtcagcaggagactattatgagagcacaaactcacattgtattagcgttatcagttaattatgatccttgggaccagtgccagccaatgggctagcagtctgctgaccatcactcagggatataactccacacccccaaattcaagcatgtaagaagacagcaggtccgcagagaggtgtggtcagggacatttcccctggccgggagcccatggagcactgtcctcagagatgcgcaggttaggctcactgtctaggccaggcccaccttagtcactgtggactggcaatggaagctcttcctggacacacctgccctagccctcaccctggggtggaagagaaatgagcttggcttgcaactcagaccattccacggaggcatcctccccttcctgggctggtgaataaaagtttcctgaggtcaaggacttccttttccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaag

SEQ ID NO: 130719 - DNA, 1826 bp, Homo sapiens
  Payload ID: 5555
  Gene Symbol: ESRRB
  Gene Name: estrogen-related receptor beta
  ENST ID: ENST00000512784
  CDS Start-End: 302-1826
catggggctgggtggagttggaagtctagagctttttgctgttttgtttaagacctggttatggttgtgagacttttttttttttttttttttttttgtcagctgcctgttatatcaatcacggagtcgggatctatttataggttgggagtactgtgtccttagtcacaaagagacacagacaggggactgtcagctggtaccggaggagcggagcaacgagttatcagcaactgaaagcacctgaggggccgcacattccaccccagcccagtcctcgtcctccacgccagccccaagcatgctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatc

SEQ ID NO: 130720 - DNA, 1427 bp, Homo sapiens
  Payload ID: 5555
  Gene Symbol: ESRRB
  Gene Name: estrogen-related receptor beta
  Uniprot ID: O95718
  ENST ID: ENST00000556177
  CDS Start-End: 73-1374
tttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggtgtgatggccccgcacacggaccaatgcccacctacagacagacaaacggacagaccg

SEQ ID NO: 130721 - DNA, 5197 bp, Homo sapiens
  Payload ID: 5556
  Gene Symbol: ESRRG
  Gene Name: estrogen-related receptor gamma
  Uniprot ID: P62508
  ENST ID: ENST00000359162
  CDS Start-End: 205-1512
ggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130722 - DNA, 5431 bp, Homo sapiens
  Payload ID: 5556
  Gene Symbol: ESRRG
  Gene Name: estrogen-related receptor gamma
  Uniprot ID: P62508
  ENST ID: ENST00000360012
  CDS Start-End: 439-1746
tatccacacacagcatcggaatattgctagctaactcaacaaatgtgcaaatcaggggactgttgtgtgtgtaccgattcatgtctatactgtttttattggtgaagtaggaaattagtctaaatatttgattctgcagttgcatgtcaccaaattcagtgaggttagatgttaaatcatcttgttggctttgggctgaatttgatctaagagacaaaagtctcaaacaacagactacttactgccaccacatctcgattcaaagaatagttttcacatgttcgtggtgtggaaaggactttctgtttctcactaatttcttcagctataccaagagtggtgttgtctttgaacaggaaggacagcaaaaataaacataacagttttttcataagatacacagctgcattacacatcccaaaattgcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130723 - DNA, 5216 bp, Homo sapiens
  Payload ID: 5556
  Gene Symbol: ESRRG
  Gene Name: estrogen-related receptor gamma
  Uniprot ID: P62508
  ENST ID: ENST00000361395
  CDS Start-End: 224-1531
agctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130724 - DNA, 5363 bp, Homo sapiens
  Payload ID: 5556
  Gene Symbol: ESRRG
  Gene Name: estrogen-related receptor gamma
  Uniprot ID: P62508
  ENST ID: ENST00000361525
  CDS Start-End: 363-1670
aaaggaggcgtgtgtaagatgtgcaatgttcctgcatgggggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 130725 - DNA, 5365 bp, Homo sapiens
  Payload ID: 5556
  Gene Symbol: ESRRG
  Gene Name: estrogen-related receptor gamma
  Uniprot ID: P62508
  ENST ID: ENST00000366937
  CDS Start-End: 268-1680
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaaactgatgtaaagttcccatcatgaatgtaattaggaattgtgcatttagatcctgaatgtggcgagaatgtgattggggtcttggagcagtcaagtctgatctggcctgtgttccttcagctaaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccattgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130726 - DNA, 5274 bp, Homo sapiens
  Payload ID: 5556
  Gene Symbol: ESRRG
  Gene Name: estrogen-related receptor gamma
  Uniprot ID: P62508
  ENST ID: ENST00000366938
  CDS Start-End: 282-1589
agctgacaatttactggttcatcaatgaaacaatattaaattatgaagatgtaaggaaaaaatcctacgctaacactgtcgcagtttgaaagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130727 - DNA, 5314 bp, Homo sapiens
  Payload ID: 5556
  Gene Symbol: ESRRG
  Gene Name: estrogen-related receptor gamma
  Uniprot ID: P62508
  ENST ID: ENST00000366940
  CDS Start-End: 319-1626
ggagggcgagggcgggctcctctggaggcggcgggctccaggccgggctccctaaacgggtcagcaattggagcgggaaggccggacagagacagggtcttgctttgtcacccaggctggagtgcagtgccacaatcagagcttactcctgccttgaactcctgggcttcagggatcctgctgcctcggccctccaagcagctgagactacagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttga

SEQ ID NO: 130728 - DNA, 5542 bp, Homo sapiens
  Payload ID: 5556
  Gene Symbol: ESRRG
  Gene Name: estrogen-related receptor gamma
  Uniprot ID: P62508
  ENST ID: ENST00000391890
  CDS Start-End: 542-1849
aagctccaatcggggctttaagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagtagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 130729 - DNA, 5216 bp, Homo sapiens
  Payload ID: 5556
  Gene Symbol: ESRRG
  Gene Name: estrogen-related receptor gamma
  Uniprot ID: P62508
  ENST ID: ENST00000408911
  CDS Start-End: 155-1531
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130730 - DNA, 2074 bp, Homo sapiens
  Payload ID: 5556
  Gene Symbol: ESRRG
  Gene Name: estrogen-related receptor gamma
  Uniprot ID: P62508
  ENST ID: ENST00000493748
  CDS Start-End: 616-1923
attctgggcaaagtgtggtgacttgtggattttcactgtgacgatgttgctacacggtccttcacttggagttagtgcaacaaggagacatctgagcttaaaatttatgaaacatctaaagaaatcaagctttatataggatcaccgttgtgggttgaattgtgtatccccaaaagatgttgaagtcctgaccacctccctataccttacaatatagccttttacggaagtagggtctttgcagaagatcaagttaagatgaaatcatttgattgggccctagttcaatatatcttatgtccttataaaaggagacaatttggacacagggacaaggggagaatgccacataaagattggaattatgctgccataagccaaggaactccaaagatcgctggcaagctgctaaaagctagcacagattcatggaacagagtctccgtcatagcctacaaaaggaatcaaccctgctgacatcttgatttcagacttctagcctccagaactagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttc

SEQ ID NO: 130731 - DNA, 583 bp, Homo sapiens
  Payload ID: 5556
  Gene Symbol: ESRRG
  Gene Name: estrogen-related receptor gamma
  ENST ID: ENST00000469486
  CDS Start-End: 306-583
aactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagatgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtg

SEQ ID NO: 130732 - DNA, 3359 bp, Homo sapiens
  Payload ID: 5556
  Gene Symbol: ESRRG
  Gene Name: estrogen-related receptor gamma
  Uniprot ID: P62508
  ENST ID: ENST00000463665
  CDS Start-End: 684-1874
aggtcccactctgtgcttccatggagaagggcggccaatgtgattctgggcaaagtgtggtgacttgtggattttcactgtgacgatgttgctacacggtccttcacttggagttagtgcaacaaggagacatctgagcttaaaatttatgaaacatctaaagaaatcaagctttatataggatcaccgttgtgggttgaattgtgtatccccaaaagatgttgaagtcctgaccacctccctataccttacaatatagccttttacggaagtagggtctttgcagaagatcaagttaagatgaaatcatttgattgggccctagttcaatatatcttatgtccttataaaaggagacaatttggacacagggacaaggggagaatgccacataaagattggaattatgctgccataagccaaggaactccaaagatcgctggcaagctgctaaaagctagcacagattcatggaacagagtctccgtcatagcctacaaaaggaatcaaccctgctgacatcttgatttcagacttctagcctccagaactctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaa

SEQ ID NO: 130733 - DNA, 584 bp, Homo sapiens
  Payload ID: 5556
  Gene Symbol: ESRRG
  Gene Name: estrogen-related receptor gamma
  ENST ID: ENST00000481543
  CDS Start-End: 434-584
tttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagactggacaacacctgataccaacaatataatgtcacctctgctatagatcacccaagaccagctgcatttacatccagatgttaactactgcagactaagctattaagagtttaacaaatacaagcactggctgagcttcagaccttccatcgaaatgcagaccactttgaacatcagcacgtgcatgtgggaattcaaactcctgacggttcattcacgatcacacatttacctggatgcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatg

SEQ ID NO: 130734 - DNA, 3015 bp, Homo sapiens
  Payload ID: 5556
  Gene Symbol: ESRRG
  Gene Name: estrogen-related receptor gamma
  Uniprot ID: P62508
  ENST ID: ENST00000487276
  CDS Start-End: 259-1566
tgacaatttactggttcatcaatgaaacaatattaaattatgaagatgtaaggaaaaaatcctacgctaacactgtcgcagtttgaaaggtccgtgagagaaaagttaattatgatgttatttcaaactttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaag

SEQ ID NO: 130735 - DNA, 1464 bp, Homo sapiens
  Payload ID: 5556
  Gene Symbol: ESRRG
  Gene Name: estrogen-related receptor gamma
  ENST ID: ENST00000475275
  CDS Start-End: 402-1464
ctggggtgcacaaataatggttgccggtcgcacatggattcggtagaactttgccttcctgaatctttttccctgcactacgaggaagagtagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcag

SEQ ID NO: 130736 - DNA, 5304 bp, Homo sapiens
  Payload ID: 5556
  Gene Symbol: ESRRG
  Gene Name: estrogen-related receptor gamma
  Uniprot ID: P62508
  ENST ID: ENST00000493603
  CDS Start-End: 312-1619
gagggcgagggcgggctcctctggaggcggcgggctccaggccgggctccctaaacgggtcagcaattggagcgggaaggccggacagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 130737 - DNA, 565 bp, Homo sapiens
  Payload ID: 5556
  Gene Symbol: ESRRG
  Gene Name: estrogen-related receptor gamma
  ENST ID: ENST00000459955
  CDS Start-End: 399-565
agtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggact

SEQ ID NO: 130738 - DNA, 569 bp, Homo sapiens
  Payload ID: 5556
  Gene Symbol: ESRRG
  Gene Name: estrogen-related receptor gamma
  ENST ID: ENST00000586199
  CDS Start-End: 303-446
tcttcacacaggaagtttccttctctgttgtcagatttagcactgtgctcttgtcatcagatccgagccaggctccctgctgcacagtagagaggcttccttaagacatttgtccttgaaactgcaccaaactcttggaagaacccagaacgtagctgacaatttactggttcatcaatgaaacaatattaaattatgaagatgtaaggaaaaaatcctacgctaacactgtcgcagtttgaaagaactgatgtaaagttcccatcatgaatgtaattaggaattgtgcatttagatcctgaatgtggcgagaatgtgattggggtcttggagcagtcaagtctgatctggcctgtgttccttcagctaaaaggagagaacccctggcgagagaggagacaggtctgctgatgaatgcaaacagaaggagcagcatctgtgcatagaggaacgaagcagggtgcgtcttgacagagtacgtggaggtcggcagaagtacaagcgcaggatagatgcggagaacagcccatacctgaaccctcagctggttcagccagccaaaaagccat

SEQ ID NO: 130739 - DNA, 5194 bp, Homo sapiens
  Payload ID: 5556
  Gene Symbol: ESRRG
  Gene Name: estrogen-related receptor gamma
  Uniprot ID: P62508
  ENST ID: ENST00000616180
  CDS Start-End: 194-1501
atagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 130740 - DNA, 1495 bp, Homo sapiens
  Payload ID: 5557
  Gene Symbol: ESX1
  Gene Name: ESX homeobox 1
  Uniprot ID: Q8N693
  ENST ID: ENST00000372588
  CDS Start-End: 85-1305
agagccagttccaaccccgggatcgccgcggaaccacgcacagagtctgcagaagtgcacagctttatcgacagcgcttgaagcatggagtctcttcgcgggtacacccacagtgatattggctaccgcagcctggcagtcggcgaggacatcgaggaagtgaatgatgagaaacttaccgtgacctcgctgatggcaaggggaggagaggacgaggagaatacacggtccaaacctgagtacggaacagaagcggaaaacaacgttggcacggaagggtccgtcccctcggacgaccaagaccgtgagggtggcggcggccacgagccggagcaacagcaggaggagccgcccctgaccaagccggagcaacagcaggaggagccgcccctgctcgagctgaagcaagagcaggaggagccgccccagacgaccgtggaggggccacagccggcggaggggccacaaaccgctgagggaccacagcccccagagaggaaacgccgccgccgcaccgcgttcacgcagtttcagctgcaggagctagagaactttttcgatgaatctcaatatcccgacgttgtggcgcgagagagacttgcagcacgcctgaatttgactgaagacagagtgcaggtttggtttcagaacagaagagccaagtggaaacgaaatcagagggtgctaatgttgagaaacactgctactgctgacctggcccaccctttggacatgttcttgggtggggcctattatgctgctcctgctctggatcctgctttgtgtgttcatctggtgccacaactacctagaccacctgtgctgcctgtgccacctatgccacccaggccacccatggtccctatgccacccaggccacccatagcacctatgccacccatggcgcctgtgccacccggctcacgcatggcgcctgtgccacccgggccacgcatggcgcctgtgccaccctggccgcccatggcgcctgtgccaccctggccgcccatggcgcctgtgccaaccgggccgcccatggcgcctgtgccacccgggccgcccatggcgcgtgtgccacccgggccgcccatggcgcgtgtgccacccgggccgcccatggcgcctctgccacccgggccgcccatggcgcctctgccacccgggccgcccatggcgcctctgccacccgggccgcccatggcgcctctgccacccaggtcacatgtgcctcacactggcctggctcctgtacacatcacatgggcccctgtcatcaacagttattatgcatgtccctttttctaaagtaaggtattcataacagtttttccaaagttctttcctgccagatagaaattgtgcacagcacagcatcaagtaattcgttagatgcttgttaaatgaagtgggtaggtgaacaaagttaacgaatgccctgttatttttgtaggccacataattgtagtattttcaataaagatgtgacttaatagta

SEQ ID NO: 130741 - DNA, 7159 bp, Homo sapiens
  Payload ID: 5558
  Gene Symbol: ETNK1
  Gene Name: ethanolamine kinase 1
  Uniprot ID: Q9HBU6
  ENST ID: ENST00000266517
  CDS Start-End: 90-1448
gtgaccggaggcgagaaaccccgcctcggcaccctgacgcagcgcaggacccgccccgcgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgctaaatatggtcgttactattttcagttttaaaaattttatagtatcaaattgtttctaaccaaaaatttccttttacttctagagatgctttatgtttttgattattaaatagtcactagtattgctaatttttgaaacaaatacacaaaatttatcatatgtagaaataagaaaatattgtttaggttaattattttttacctatccagagtcattccttacatttcagtttcatgtttcattcctcacattttagtttcatgttttagtttgattctatgtttttagactgatagcaaatgattacttgatacatgtaagttcagcgttatatgttgaggcagttatataattaaataaggaacacttagggcattgatcttgtacacttaaaatctgacaaatgacaaaatgtgaattaagcataaatagtcatggcaggagggcttttgtttatttctcttgtttttgtttaactgtatttttaattttgtctggtggtaagagggaggtaattattgtatggaaagaagttagatctttcagatagataaataggcttcaggttttgaagtctgctctgtgtagttgagcagtcatggttaactttacttagaaaattagtctgacaagctttgcacttcggtcacataagtgcccatgtacaaagttggcttactggatctgcatattcaaaatatgcaactacaaatttatcctctgagaaatcttctgaggagtctaatgtattccaaatgacttaatattctcagacaaatgctttaaaatacttggattatctcaagatttttgaagctaataaagtaaatagaaacacaggccattttaaatggtaaattctagttacataaatataatcttaaagtatgtttgtatctgtaacagtgttagaccagatttggtttctacctccccaatgttataaatgttcacttttgtttttataaaccatattactgtaagatcaatagaactttgcctagttaagtgaatggaaccaattaaacaactagtagctttttataatgttagtgtgaacttgaaaaattgtttttggtggaatttttgtctgtggttagaacattttcataaaacagataaagaatgtgtaatactcttaattttttttttttttttttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtccaataatctgaagtagtttcctatatttatctgtactaaattgactataaattgagtctgcaaagaggaaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaaatttgttctgtggataaaatgaggttggcagtgaagaaaattaaaaacagcctcattcatgtaactggttaagtaaaaatacattttcactatgtgttcataaacttttaatgaagctgtttgtctttcagttcaaatataagtgatgtttaggctttatttctgttaataaggctttttaccattgattaaatgaaggaatgtatctttttgaagagatttatattctgtaaataaaaattcgttgtaacaataaagttgagttctaactaca

SEQ ID NO: 130742 - DNA, 1083 bp, Homo sapiens
  Payload ID: 5558
  Gene Symbol: ETNK1
  Gene Name: ethanolamine kinase 1
  Uniprot ID: Q9HBU6
  ENST ID: ENST00000335148
  CDS Start-End: 24-800
gccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcagtttatcatcgttgactctttgcaaaggaaaaactacaagatgttttggattaaccggctgcagagggtcaaggcttctgcttagttttttctagttagtgtttgagttgaagtgttatacatttcttactgccgattgcttattacttaattgttcatgttttcagagttcttgcctattaaaattttattaatttggttaacaattctttgttctttacgttgttcattatttaatttaatatattatgttttctataaagaataatgtcatatatgcttgatcatttttccaaaattgccagctttaaaaattctctttctgctcttgaaaactctagaaaatggtctggatttgaaaacagcattcataggtta

SEQ ID NO: 130743 - DNA, 617 bp, Homo sapiens
  Payload ID: 5558
  Gene Symbol: ETNK1
  Gene Name: ethanolamine kinase 1
  ENST ID: ENST00000545979
  CDS Start-End: 1-248
gtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagaagccgctgcgtaagtgacggacccatccacggggggagattcctgctgatagttgcccctcctcccactccccagtccacggtcactgcaaaatgaacctttccactccccttgcacggggtcctcgtctacctcctcccctcccaccagtaatgcagtcattaatcctctctgatctttccttcctctcccctccccctgcgatgtgctttcattgatgcctcacactgcgttttgtcttcccaaaccctagcgtactcaattcccaaagtaatgaccacgaccatgcatcgctaggtcggttcttaggcagcaccacacacattgttttgtttgagtcgatatttctgaattattaaagtcgtcttactgaaattaatacctga

SEQ ID NO: 130744 - DNA, 1659 bp, Homo sapiens
  Payload ID: 5558
  Gene Symbol: ETNK1
  Gene Name: ethanolamine kinase 1
  ENST ID: ENST00000538218
  CDS Start-End: 1-1277
ccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattgggtgaaaacttgaattttatcattggcaacaaatattgtcagttattttcactgaaatggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaa

SEQ ID NO: 130745 - DNA, 843 bp, Homo sapiens
  Payload ID: 5559
  Gene Symbol: ETNK2
  Gene Name: ethanolamine kinase 2
  ENST ID: ENST00000367197
  CDS Start-End: 409-615
ctggcttcacggagctgttcttccggctggcacttggacaagcaaaagttagaccttgatttaggtcttaagttaatttgtaggagggaagggggaaaggaaataaaaaattcccactttgaaaagtctgtgccaagggccagtctcagtggctcatgcctataatcccagcagtttgggaggccaaggcatgtggattgcttaagcccaggaattcaagaccagcccaggcaatgtggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccc

SEQ ID NO: 130746 - DNA, 2431 bp, Homo sapiens
  Payload ID: 5559
  Gene Symbol: ETNK2
  Gene Name: ethanolamine kinase 2
  Uniprot ID: Q9NVF9
  ENST ID: ENST00000367201
  CDS Start-End: 43-1227
gctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgga

SEQ ID NO: 130747 - DNA, 2434 bp, Homo sapiens
  Payload ID: 5559
  Gene Symbol: ETNK2
  Gene Name: ethanolamine kinase 2
  Uniprot ID: Q9NVF9
  ENST ID: ENST00000367202
  CDS Start-End: 152-1312
cggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgga

SEQ ID NO: 130748 - DNA, 547 bp, Homo sapiens
  Payload ID: 5559
  Gene Symbol: ETNK2
  Gene Name: ethanolamine kinase 2
  ENST ID: ENST00000429525
  CDS Start-End: 512-547
aaaactaggctcacacctcccttggccctgcacacgcccccctcctcccggggctcttaggcacgcctggtggccacctgcccactgtcggcatgctgcgtgtgcgggccgcaccccctgtcgctgcgtgctggtgcccctcgctgaccagaagcgcgtacccagccagctctgaaacctgaggaggcgggaacttttaagagaccccccgcccccccgacccagccatacatgcatacattgctgccccttctccaccccatggtgggagcaaatcctccaggctctgagctgcccctgtgggtcccaggagccaccctgtggaattccagctagcactcagctcctcaccatcgctgcaggctcgggctcagcacccccacacaggccatcttccccagccccagctggacacagagaaccttgctcgcagcccagttgtctcctgtcttttctgcgcttcacggatggcatcaccaacaagctggtggcctgctatgtggaggaggacatgcaggactgcgtgctggtccgggtgtatggggag

SEQ ID NO: 130749 - DNA, 577 bp, Homo sapiens
  Payload ID: 5559
  Gene Symbol: ETNK2
  Gene Name: ethanolamine kinase 2
  ENST ID: ENST00000452983
  CDS Start-End: 1-577
aattcattctcctctcttctgctgagaccttccttctgcaggacctgtgctcctaagggacttgcaatcatcccatccttggccctctggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagt

SEQ ID NO: 130750 - DNA, 653 bp, Homo sapiens
  Payload ID: 5559
  Gene Symbol: ETNK2
  Gene Name: ethanolamine kinase 2
  ENST ID: ENST00000422699
  CDS Start-End: 1-653
agacggttggggggtgggacagcggaagggaagactggaagaggactgggagggcccagctgggacacagggcctcgggcgatggggtctttatcaaggccctccttctctgaccggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaa

SEQ ID NO: 130751 - DNA, 443 bp, Homo sapiens
  Payload ID: 5559
  Gene Symbol: ETNK2
  Gene Name: ethanolamine kinase 2
  ENST ID: ENST00000444817
  CDS Start-End: 1-443
tatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcg

SEQ ID NO: 130752 - DNA, 671 bp, Homo sapiens
  Payload ID: 5559
  Gene Symbol: ETNK2
  Gene Name: ethanolamine kinase 2
  ENST ID: ENST00000422072
  CDS Start-End: 1-449
agcagggttttggttggttggttagctggcttcacggagctgttcttccggctggcacttggacaagcaaaagtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtcccct

SEQ ID NO: 130753 - DNA, 2099 bp, Homo sapiens
  Payload ID: 5560
  Gene Symbol: ETNPPL
  Gene Name: ethanolamine-phosphate phospho-lyase
  Uniprot ID: Q8TBG4
  ENST ID: ENST00000296486
  CDS Start-End: 156-1655
acgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaaaaaaaa

SEQ ID NO: 130754 - DNA, 2028 bp, Homo sapiens
  Payload ID: 5560
  Gene Symbol: ETNPPL
  Gene Name: ethanolamine-phosphate phospho-lyase
  Uniprot ID: Q8TBG4
  ENST ID: ENST00000411864
  CDS Start-End: 111-1592
gggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaac

SEQ ID NO: 130755 - DNA, 567 bp, Homo sapiens
  Payload ID: 5560
  Gene Symbol: ETNPPL
  Gene Name: ethanolamine-phosphate phospho-lyase
  ENST ID: ENST00000512320
  CDS Start-End: 388-567
agacaccattccagggatgggagatgggtggaagaaggatagcgctccgccacccccacacaactcgaaagtttttggaaactgtgaactgagaaatattttttcatgatggctccgcaaacaaaccaattctgacaatttttacttaaagtgagctttttcttcttgcatgcttggttaagtgatgaagggtttatctagccaatagaaaaacttgaaaccaccttctgttagaaaagcagagactttatttagatccctcttacccaacttgctctcccaagctgtgttcttcccagcctgcttgtcttgcccccgtcacaaacgacttagtaatataaagtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatc

SEQ ID NO: 130756 - DNA, 680 bp, Homo sapiens
  Payload ID: 5560
  Gene Symbol: ETNPPL
  Gene Name: ethanolamine-phosphate phospho-lyase
  ENST ID: ENST00000505233
  CDS Start-End: 32-226
gcaccttcgcagcgccctgcaccccgccaccatgtgcgagctgtacagtaagcgggacactctggggctgaggaagaagcacatcgggccctcatgcaaagttttctttgcatcggatcccatcaaaatagtgagagcccagaggcagtacatgtttgatgagaacggtgaacagtacttggactgcatcaacaatgttgcccatgatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgt

SEQ ID NO: 130757 - DNA, 1692 bp, Homo sapiens
  Payload ID: 5560
  Gene Symbol: ETNPPL
  Gene Name: ethanolamine-phosphate phospho-lyase
  ENST ID: ENST00000510706
  CDS Start-End: 298-1677
acgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcgggtaagggcaccctggcccggaagccctcatgcaaagttttctttgcatcggatcccatcaaaatagtgagagcccagaggcagtacatgtttgatgagaacggtgaacagtacttggactgcatcaacaatgttgcccatgtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcatttta

SEQ ID NO: 130758 - DNA, 543 bp, Homo sapiens
  Payload ID: 5560
  Gene Symbol: ETNPPL
  Gene Name: ethanolamine-phosphate phospho-lyase
  ENST ID: ENST00000510723
  CDS Start-End: 332-543
gtgcacgcgccccgcgcgcctccacctgcaggggccgcgcggactcccagaaacgctcctggaacccggaacgctgggcttcctgcccgctcgaaagtccccggctcgctctgcagccggcggactagcgggggctgccggccggctagaggggttggtggatgacggccaatagccctagcagacaccattccagggatgggagatgggtggaagaaggatagcgctccgccacccccacacaactcgaaagtttttggaaactgtgaactgagaaatattttttcatgatggctccgcaaacaaaccaattctgacaatttttacttaaatgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggcca

SEQ ID NO: 130759 - DNA, 576 bp, Homo sapiens
  Payload ID: 5560
  Gene Symbol: ETNPPL
  Gene Name: ethanolamine-phosphate phospho-lyase
  ENST ID: ENST00000509402
  CDS Start-End: 157-306
gacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaagcgggacactctggggctgaggaagaagcacatcggtgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagaga

SEQ ID NO: 130760 - DNA, 1561 bp, Homo sapiens
  Payload ID: 5560
  Gene Symbol: ETNPPL
  Gene Name: ethanolamine-phosphate phospho-lyase
  Uniprot ID: Q8TBG4
  ENST ID: ENST00000512646
  CDS Start-End: 144-1469
aggctcgcgtaggaggcgcgcagaccttgcaccttgcaccttcgcagcgccctgcaccccgccaccatgtgcgagctgtacagtaagcgggacactctggggctgaggaagaagcacatcgggtaagggcaccctggcccggaatgggacactgtcacccaggagtggtcaaagctgccctgaaacagatggaactgctaaatacaaattctcgattcctccacgacaacattgttgagtatgccaaacgcctttcagcaactctgccggagaaactctctgtttgttattttacaaattcaggatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaa

SEQ ID NO: 130761 - DNA, 8101 bp, Homo sapiens
  Payload ID: 5561
  Gene Symbol: EPT1
  Gene Name: ethanolaminephosphotransferase 1
  Uniprot ID: Q9C0D9
  ENST ID: ENST00000260585
  CDS Start-End: 120-1313
ctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcttttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaacatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattttaaggtcacgtcctatagtttgggggcccttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggatcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttt

SEQ ID NO: 130762 - DNA, 624 bp, Homo sapiens
  Payload ID: 5561
  Gene Symbol: EPT1
  Gene Name: ethanolaminephosphotransferase 1
  ENST ID: ENST00000447170
  CDS Start-End: 85-624
cttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctaggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcttttgccaacagtaca

SEQ ID NO: 130763 - DNA, 504 bp, Homo sapiens
  Payload ID: 5561
  Gene Symbol: EPT1
  Gene Name: ethanolaminephosphotransferase 1
  ENST ID: ENST00000442141
  CDS Start-End: 151-504
aaaggttaaagaaagagggaccaattaacttcaccttttcctaaacttgaaaagacaaaccaaattctgcccttcatctccaatgtttgaaagatcagaggttcctgtcaatacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggt

SEQ ID NO: 130764 - DNA, 8126 bp, Homo sapiens
  Payload ID: 5561
  Gene Symbol: EPT1
  Gene Name: ethanolaminephosphotransferase 1
  ENST ID: ENST00000613142
  CDS Start-End: 148-1338
acgcgtgcgcggtgggcggagcgcggctctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcttttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagatctaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaacatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattttaaggtcacgtcctatagtttgggggcccttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggatcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttt

SEQ ID NO: 130765 - DNA, 963 bp, Homo sapiens
  Payload ID: 5562
  Gene Symbol: ETHE1
  Gene Name: ethylmalonic encephalopathy 1
  Uniprot ID: O95571
  ENST ID: ENST00000292147
  CDS Start-End: 68-832
agtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 130766 - DNA, 648 bp, Homo sapiens
  Payload ID: 5562
  Gene Symbol: ETHE1
  Gene Name: ethylmalonic encephalopathy 1
  ENST ID: ENST00000602138
  CDS Start-End: 16-171
cccgcagtgggcgcgatggcggaggctgtactgagggtcgcccggcggcagctgagccagcgcggcgggtctggagcccccatcctcctgcggcaggtgcgggtggctggacctaggaggggactgctgggcactaggcggcagcaaggacggaactccggggtctcttaatagggagagatccggggggacccacgcctgcatcttgcggaaagcggggtggaggtttagggctggactcttgggtcctttaaagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgat

SEQ ID NO: 130767 - DNA, 1052 bp, Homo sapiens
  Payload ID: 5562
  Gene Symbol: ETHE1
  Gene Name: ethylmalonic encephalopathy 1
  ENST ID: ENST00000600651
  CDS Start-End: 25-807
attcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagataggtgagcagctggggacctggacttctgggtctgagagaggaggggctggggtcttggactcctgggtctgagagaggaggggctgggggcctggactcctgggtctgagggaggaggggctgggggcctggactcctgggtctgagggaggagaggctgggggcctggactcctgggtctaagggaggaggggctgggggactggactcctgggtctgaggcagtaggggctgggggcctggactcctggctctgagggagtaggggctgggctgggggcctgggctcctgagtctgagggaggaggggctggggg

SEQ ID NO: 130768 - DNA, 915 bp, Homo sapiens
  Payload ID: 5562
  Gene Symbol: ETHE1
  Gene Name: ethylmalonic encephalopathy 1
  ENST ID: ENST00000598330
  CDS Start-End: 46-333
gcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctggcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagataggtgagcagctggggacctggacttctgggtctgagagaggaggggctggggtcttggactcctgggtctgagagaggaggggctgggggcctggactcctgggtctgagggaggaggggctgggggcctggactcctgggtctgagggaggagaggctgggggcctggactcctgggtctaagggaggaggggctgggggactggactcctgggtctgaggcagtaggggctgggggcctggactcctggctctgagggagtaggggctgggctgggggcctgggctcctgagtctgagggaggagg

SEQ ID NO: 130769 - DNA, 702 bp, Homo sapiens
  Payload ID: 5562
  Gene Symbol: ETHE1
  Gene Name: ethylmalonic encephalopathy 1
  ENST ID: ENST00000594342
  CDS Start-End: 29-316
gctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctggcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggc

SEQ ID NO: 130770 - DNA, 909 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000368289
  CDS Start-End: 65-502
aagtcaccaccgtggcctgcgacggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaattta

SEQ ID NO: 130771 - DNA, 1354 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000368291
  CDS Start-End: 267-704
ggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaa

SEQ ID NO: 130772 - DNA, 1966 bp, Homo sapiens
  Payload ID: 5563
  Gene Symbol: ECHDC1
  Gene Name: ethylmalonyl-CoA decarboxylase 1
  ENST ID: ENST00000368295
  CDS Start-End: 3-380
aaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggcaaacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactattt

SEQ ID NO: 130773 - DNA, 767 bp, Homo sapiens
  Payload ID: 5563
  Gene Symbol: ECHDC1
  Gene Name: ethylmalonyl-CoA decarboxylase 1
  ENST ID: ENST00000417628
  CDS Start-End: 1-229
gatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagtagaatgtgtggtgaagtggtctgtatccagaggagatgagaaaaagaactatggattggaaagtttttacagctttctgaggaatatgaattgactttgcacctaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaaca

SEQ ID NO: 130774 - DNA, 766 bp, Homo sapiens
  Payload ID: 5563
  Gene Symbol: ECHDC1
  Gene Name: ethylmalonyl-CoA decarboxylase 1
  ENST ID: ENST00000436638
  CDS Start-End: 1-766
gtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggaaagttgcagatggaatacagagttcctgtacaccctgcatccagtttccccttttattaacatcttatattcctatggatggaatggccgtatgcatgttcatgcaaaacaccttaacaagatttatgaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatg

SEQ ID NO: 130775 - DNA, 2341 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000454859
  CDS Start-End: 277-1182
gtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaaca

SEQ ID NO: 130776 - DNA, 1009 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000430841
  CDS Start-End: 104-1009
acgcaaaacggaaaagcgtgtgtaggggagcggaaaaggaagtcaccaccgtggcctgcgacggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataa

SEQ ID NO: 130777 - DNA, 1515 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000454591
  CDS Start-End: 233-913
gatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaaca

SEQ ID NO: 130778 - DNA, 1368 bp, Homo sapiens
  Payload ID: 5563
  Gene Symbol: ECHDC1
  Gene Name: ethylmalonyl-CoA decarboxylase 1
  ENST ID: ENST00000479525
  CDS Start-End: 275-652
gacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagggagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaa

SEQ ID NO: 130779 - DNA, 301 bp, Homo sapiens
  Payload ID: 5563
  Gene Symbol: ECHDC1
  Gene Name: ethylmalonyl-CoA decarboxylase 1
  ENST ID: ENST00000460558
  CDS Start-End: 1-301
gaactccagaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaat

SEQ ID NO: 130780 - DNA, 617 bp, Homo sapiens
  Payload ID: 5563
  Gene Symbol: ECHDC1
  Gene Name: ethylmalonyl-CoA decarboxylase 1
  ENST ID: ENST00000461239
  CDS Start-End: 1-104
gatttatgagacttcctttaataagtgttgcgctggttcaaggttgggcattgggtggaggagcagaatttactacagcatgtgatttcagtttcagacactgaagagaaagtgattctgcgctggcatgtagtgctctacatatttcaaaacatcatgttgtacatttaaaaacttttaagcctggcgtggtggctcatgcctgttatcccagcattttggggggctgaaataggcagatcacctgaggtcaggagtttgagaccagcctggccaacatggtgaaaccctatctctactcaaaatacaaaaattagccaggtgtggtggcacatgcctgtagtcctacaacttgggagtctgaggtggaaggattgcttgaacctgggaggtggaggttacagtgagccaagatcacaccattgcactccagcctgggcaacagagtgagactctgtctcaaataaataaataaataaataaatttgttgagctacaaattatatacaataaaatgaatccattttaattgtatgctgtaaatggattttgatgaatatatacacccatgtaaccacctccacaatcaagattgagaacatttttatcacccctat

SEQ ID NO: 130781 - DNA, 534 bp, Homo sapiens
  Payload ID: 5563
  Gene Symbol: ECHDC1
  Gene Name: ethylmalonyl-CoA decarboxylase 1
  ENST ID: ENST00000526299
  CDS Start-End: 27-278
aagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcagaattcagagagatttctctataccagtgctgaccaatgaaaacataatgtaagaaacaaaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaa

SEQ ID NO: 130782 - DNA, 531 bp, Homo sapiens
  Payload ID: 5563
  Gene Symbol: ECHDC1
  Gene Name: ethylmalonyl-CoA decarboxylase 1
  ENST ID: ENST00000531582
  CDS Start-End: 125-531
aacattccaggaagggaagccagcctgtgaagaagcatggcattgaaacaggtggcttggtagtgagcttgttcagctccactgaatcttctttgtggtggggctgcaagacatcctgcatgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaag

SEQ ID NO: 130783 - DNA, 2443 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000474289
  CDS Start-End: 389-1294
ggcctgcgacggtaagtggtcgtaagggttggtcttagcgcttcagtttagtgttgtcagtgggagaatcctaaaatgtcgccgtggaatggactgtaccgctcgcttctccaaacgtgtcccagacggcgagcctccccggctccgcggcttgtcccttgcaagcgccgcgcaggcctgccccgcgctggacgtggagacgcggtgccgagcgccacgggccggctgtgcgccggccggggaaagagggcgaggggaagagatgaatcggtcttcccagagcgcgccgcgaggtcgcgagattacactttaaaaagcatgaggaggcttgctttctacatgctgatttaatttcggaatacattcgaggccctgtgctaagttagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtg

SEQ ID NO: 130784 - DNA, 601 bp, Homo sapiens
  Payload ID: 5563
  Gene Symbol: ECHDC1
  Gene Name: ethylmalonyl-CoA decarboxylase 1
  ENST ID: ENST00000525745
  CDS Start-End: 65-601
aagtcaccaccgtggcctgcgacggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggaaagttgcagatggaatacagagttcctgtacaccctgcatccagtttccccttttattaacatcttatattcctatggatggaatggccgtatgcatgttcatgcaaaacaccttaacaagatttatgagacttcctttaataagtgttgcgctggttcaaggttgggcatt

SEQ ID NO: 130785 - DNA, 577 bp, Homo sapiens
  Payload ID: 5563
  Gene Symbol: ECHDC1
  Gene Name: ethylmalonyl-CoA decarboxylase 1
  ENST ID: ENST00000534442
  CDS Start-End: 124-577
gtggcctgcgacgtggcttggtagtgagcttgttcagctccactgaatcttctttgtggtggggctgcaagacatcctgcatggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttggg

SEQ ID NO: 130786 - DNA, 1449 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000528402
  CDS Start-End: 220-432
acgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaaca

SEQ ID NO: 130787 - DNA, 2585 bp, Homo sapiens
  Payload ID: 5563
  Gene Symbol: ECHDC1
  Gene Name: ethylmalonyl-CoA decarboxylase 1
  Uniprot ID: Q9NTX5
  ENST ID: ENST00000531967
  CDS Start-End: 505-1428
caagaacgaaagatgagcaactcctttctggtagaggttctttcattggagaatttttgagctacaataatccttttaacgctgcgcacacatacagggattacacgtgtaggggattaaaaacacagttaagtttaggttgaaggtgctgttaaggacttcaggcaacattaaatcaacactcagttctttgctctgttccacatctgggctcctgtatagcagttgttgctctaggtgctagaggtatgcagaggaactggacaagggcaaggaaaacaaagggctccttctttagaagagctagcattctcttggaacagacaagcttgtggtgagaagtatatttgtgaaatctacgaggggagggagcagcgcagtaatagaacgggcgatcctttcttgattttttattgggttctggcctgaaaggcgactgtataatcagctgggattcctgcaatgattaacattccaggaagggaagccagcctgtgaagaagcatggcattgaaacaggaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 130788 - DNA, 854 bp, Homo sapiens
  Payload ID: 5563
  Gene Symbol: ECHDC1
  Gene Name: ethylmalonyl-CoA decarboxylase 1
  ENST ID: ENST00000368292
  CDS Start-End: 27-446
aagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgtt

SEQ ID NO: 130789 - DNA, 2455 bp, Homo sapiens
  Payload ID: 5564
  Gene Symbol: EI24
  Gene Name: etoposide induced 2.4
  Uniprot ID: O14681
  ENST ID: ENST00000278903
  CDS Start-End: 429-1451
atctgtgagaacgggatcggcgaggaggcgacggggaggaggcgacgcggaggggtgaggggtcctctccgccgccaggcggagttgggagccggacgatcccgcacgcagcgcgaggcgggaccccggactgactacatttcccagtctccgtcgctccgcgcggcccaccccttcggctctgggccccgcctcgtggtgccggctggttcttcgcgctcgcccgacttcccagcggccccgtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaagtg

SEQ ID NO: 130790 - DNA, 1625 bp, Homo sapiens
  Payload ID: 5564
  Gene Symbol: EI24
  Gene Name: etoposide induced 2.4
  ENST ID: ENST00000527235
  CDS Start-End: 156-944
gcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaa

SEQ ID NO: 130791 - DNA, 534 bp, Homo sapiens
  Payload ID: 5564
  Gene Symbol: EI24
  Gene Name: etoposide induced 2.4
  ENST ID: ENST00000527131
  CDS Start-End: 160-534
agttttctgccgaattgcctaggagctgtggggagatgggcctgaatggacccgtggactcagaggcagcccgtggagccccgtgggaaatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaatt

SEQ ID NO: 130792 - DNA, 815 bp, Homo sapiens
  Payload ID: 5564
  Gene Symbol: EI24
  Gene Name: etoposide induced 2.4
  ENST ID: ENST00000527842
  CDS Start-End: 255-815
agtgcgggcgcagcggccccggccctggaagcgccccggcggagctggcctgcggtgggctaggggcagggccggagccgcggcggcggagctgtgggtttgagaggttatttgtccatgggatgctcgtgttaaaacaaaaatcttcattgcaaagcttaagtaaaaacaagtctcgaccgagatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcag

SEQ ID NO: 130793 - DNA, 452 bp, Homo sapiens
  Payload ID: 5564
  Gene Symbol: EI24
  Gene Name: etoposide induced 2.4
  ENST ID: ENST00000527520
  CDS Start-End: 179-452
agttgtgcctagggagaccagttttctgccgaattgcctaggagctgtggggagatgggcctgaatggacccgtggactcagaggcagcccgtggagccccgtgggaaatccttcatgatgagagatttggggacacttctctctcctgtgtgtagttgatagtttggtggtgaagagatggctgacagtgtcaaaacctttctccaggaccttgccagactagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcg

SEQ ID NO: 130794 - DNA, 837 bp, Homo sapiens
  Payload ID: 5564
  Gene Symbol: EI24
  Gene Name: etoposide induced 2.4
  ENST ID: ENST00000524723
  CDS Start-End: 187-837
gtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagacggattcttgccctgtcaccaagctgtcacctgagattgccgtggtgcaatctcagcttactgcagcctctgcctcccaggtccaagcaattcttctgcctcagcgaaccggctggctggaagtacagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatg

SEQ ID NO: 130795 - DNA, 493 bp, Homo sapiens
  Payload ID: 5564
  Gene Symbol: EI24
  Gene Name: etoposide induced 2.4
  ENST ID: ENST00000529812
  CDS Start-End: 452-493
ctctccgccgccaggcggagttgggagccggacgatcccgcacgcagcgcgaggcgggaccccggactgactacatttcccagtctccgtcgctccgcgcggcccaccccttcggctctgggccccgcctcgtggtgccggctggttcttcgcgctcgcccgacttcccagcggccccgtgcggcccgggcatgcccagtgcgggcgcagcggccccggccctggaagcgccccggcggagctggcctgcggtgggctaggggcagggccggagccgcggcggcggagctgtgggtttgagaggttatttgtccatgggatgctcgtgttaaaacaaaaatcttcattgcaaagcttaagtaaaaacaagtctcgaccgagatccttcatgatgagagatttggggacacttctctctcctgtgtgtagttgatagtttggtggtgaagagatggctgacagtgtcaaaacctttctccaggaccttgccaga

SEQ ID NO: 130796 - DNA, 1407 bp, Homo sapiens
  Payload ID: 5564
  Gene Symbol: EI24
  Gene Name: etoposide induced 2.4
  ENST ID: ENST00000615917
  CDS Start-End: 560-1063
gtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagatgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttct

SEQ ID NO: 130797 - DNA, 1395 bp, Homo sapiens
  Payload ID: 5564
  Gene Symbol: EI24
  Gene Name: etoposide induced 2.4
  ENST ID: ENST00000531636
  CDS Start-End: 168-293
agtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcgaggccctttaagaatgggtactgttgttctatccattttatgaatgaggaaatgcaagttaccaaggttaaaccattagtaagaggcaaagctgagatttaaacccagatggtatcctgcagatagcgtactggtaatcactgtggcatctcgttaccatcatgtaagcaggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgcca

SEQ ID NO: 130798 - DNA, 1544 bp, Homo sapiens
  Payload ID: 5564
  Gene Symbol: EI24
  Gene Name: etoposide induced 2.4
  Uniprot ID: O14681
  ENST ID: ENST00000534546
  CDS Start-End: 187-1167
gtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagactagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattcta

SEQ ID NO: 130799 - DNA, 1747 bp, Homo sapiens
  Payload ID: 5564
  Gene Symbol: EI24
  Gene Name: etoposide induced 2.4
  ENST ID: ENST00000618552
  CDS Start-End: 718-1221
gtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaccttttctatagggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggtttt

SEQ ID NO: 130800 - DNA, 1718 bp, Homo sapiens
  Payload ID: 5564
  Gene Symbol: EI24
  Gene Name: etoposide induced 2.4
  Uniprot ID: O14681
  ENST ID: ENST00000620753
  CDS Start-End: 128-1150
gtgcggcccgggcatgcccagtgcgggcgcagcggccccggccctggaagcgccccgatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaa

SEQ ID NO: 130801 - DNA, 3150 bp, Homo sapiens
  Payload ID: 5565
  Gene Symbol: EHF
  Gene Name: ets homologous factor
  Uniprot ID: Q9NZC4
  ENST ID: ENST00000257831
  CDS Start-End: 122-1024
acttgataacacccgtggtgccccatccctataggagctggtgagattgcagcctgctgcctcccctccaacagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaa

SEQ ID NO: 130802 - DNA, 2519 bp, Homo sapiens
  Payload ID: 5565
  Gene Symbol: EHF
  Gene Name: ets homologous factor
  Uniprot ID: Q9NZC4
  ENST ID: ENST00000450654
  CDS Start-End: 98-931
atccctataggagctggtgagattgcagcctgctgcctcccctccaacagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtca

SEQ ID NO: 130803 - DNA, 557 bp, Homo sapiens
  Payload ID: 5565
  Gene Symbol: EHF
  Gene Name: ets homologous factor
  ENST ID: ENST00000532302
  CDS Start-End: 83-557
gattattcatttatgaatgggtggctgtaaaaacttgcctcatgcatatgaaaattgaacctggaaatttttaattgctatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtag

SEQ ID NO: 130804 - DNA, 560 bp, Homo sapiens
  Payload ID: 5565
  Gene Symbol: EHF
  Gene Name: ets homologous factor
  ENST ID: ENST00000529527
  CDS Start-End: 62-560
ttctcaccctgcctttgttactgggaaaccgaacgcggcgctgtggctttcagcttggatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagcagagtcacctgatatgaaaaagg

SEQ ID NO: 130805 - DNA, 1280 bp, Homo sapiens
  Payload ID: 5565
  Gene Symbol: EHF
  Gene Name: ets homologous factor
  Uniprot ID: Q9NZC4
  ENST ID: ENST00000530286
  CDS Start-End: 141-1043
ctcagcagcaacaaatgccttctgagacagggattcttttgattttgcttggacattgtggagaagtgttagccccaatgtggactgatctgggaacagtgggaaattaacttcttgttggtaaatatcaggctgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatga

SEQ ID NO: 130806 - DNA, 564 bp, Homo sapiens
  Payload ID: 5565
  Gene Symbol: EHF
  Gene Name: ets homologous factor
  ENST ID: ENST00000525253
  CDS Start-End: 46-564
gttactgggaaaccgaacgcggcgctgtggctttcagcttggatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatg

SEQ ID NO: 130807 - DNA, 1481 bp, Homo sapiens
  Payload ID: 5565
  Gene Symbol: EHF
  Gene Name: ets homologous factor
  Uniprot ID: Q9NZC4
  ENST ID: ENST00000531794
  CDS Start-End: 127-1095
aacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttag

SEQ ID NO: 130808 - DNA, 1501 bp, Homo sapiens
  Payload ID: 5565
  Gene Symbol: EHF
  Gene Name: ets homologous factor
  Uniprot ID: Q9NZC4
  ENST ID: ENST00000533754
  CDS Start-End: 218-1120
attttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatga

SEQ ID NO: 130809 - DNA, 557 bp, Homo sapiens
  Payload ID: 5565
  Gene Symbol: EHF
  Gene Name: ets homologous factor
  ENST ID: ENST00000527935
  CDS Start-End: 5-385
gatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgcca

SEQ ID NO: 130810 - DNA, 485 bp, Homo sapiens
  Payload ID: 5565
  Gene Symbol: EHF
  Gene Name: ets homologous factor
  ENST ID: ENST00000531728
  CDS Start-End: 56-436
ccctgcctttgttactgggaaaccgaacgcggcgctgtggctttcagcttggatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtca

SEQ ID NO: 130811 - DNA, 6348 bp, Homo sapiens
  Payload ID: 5566
  Gene Symbol: ETV1
  Gene Name: ets variant 1
  Uniprot ID: P50549
  ENST ID: ENST00000242066
  CDS Start-End: 336-1715
cgttattggctgcgggaagaacctcgccgggacctaacccgaagctccgccccctcgcggttaccctggatacccgtcaggctcgggctgcagagaaggaggatcagggcaagtggcttcagagatgcagccctcactgcttaacgtcctagttattgtccttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 130812 - DNA, 6096 bp, Homo sapiens
  Payload ID: 5566
  Gene Symbol: ETV1
  Gene Name: ets variant 1
  Uniprot ID: P50549
  ENST ID: ENST00000399357
  CDS Start-End: 339-1463
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 130813 - DNA, 4181 bp, Homo sapiens
  Payload ID: 5566
  Gene Symbol: ETV1
  Gene Name: ets variant 1
  ENST ID: ENST00000405358
  CDS Start-End: 108-1583
gactctgcttctagaagcccagtcttcaaaatgagcttacctttcagtgatttggataaggcatagttttgtttttaagacccctttttctgattaaagtgcccaacatgagtggaagaggagatggagggcagcagcagctgctgcactcaaagtttttggctgggtttgtctgccacattgaaaagaatgaaagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaaga

SEQ ID NO: 130814 - DNA, 3363 bp, Homo sapiens
  Payload ID: 5566
  Gene Symbol: ETV1
  Gene Name: ets variant 1
  Uniprot ID: P50549
  ENST ID: ENST00000403527
  CDS Start-End: 339-1652
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaa

SEQ ID NO: 130815 - DNA, 4402 bp, Homo sapiens
  Payload ID: 5566
  Gene Symbol: ETV1
  Gene Name: ets variant 1
  Uniprot ID: P50549
  ENST ID: ENST00000405192
  CDS Start-End: 202-1566
gagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgac

SEQ ID NO: 130816 - DNA, 3391 bp, Homo sapiens
  Payload ID: 5566
  Gene Symbol: ETV1
  Gene Name: ets variant 1
  Uniprot ID: P50549
  ENST ID: ENST00000405218
  CDS Start-End: 473-1906
agtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttc

SEQ ID NO: 130817 - DNA, 1603 bp, Homo sapiens
  Payload ID: 5566
  Gene Symbol: ETV1
  Gene Name: ets variant 1
  Uniprot ID: P50549
  ENST ID: ENST00000403685
  CDS Start-End: 216-1595
accccctgcttggttgcaccctcagatagtacccatgagcttcactgttcagcctcggggcccaggcgcttcctggaatctctccttggccggggttaaaatgcagttcccgctcaaaatgcttataggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtg

SEQ ID NO: 130818 - DNA, 554 bp, Homo sapiens
  Payload ID: 5566
  Gene Symbol: ETV1
  Gene Name: ets variant 1
  ENST ID: ENST00000421381
  CDS Start-End: 186-554
cgttattggctgcgggaagaacctcgccgggacctaacccgaagctccgccccctcgcggttaccctggatacccgtcaggctcgggctgcagagaaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcc

SEQ ID NO: 130819 - DNA, 1141 bp, Homo sapiens
  Payload ID: 5566
  Gene Symbol: ETV1
  Gene Name: ets variant 1
  ENST ID: ENST00000438956
  CDS Start-End: 277-1141
agtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatg

SEQ ID NO: 130820 - DNA, 784 bp, Homo sapiens
  Payload ID: 5566
  Gene Symbol: ETV1
  Gene Name: ets variant 1
  ENST ID: ENST00000443608
  CDS Start-End: 266-784
aaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttat

SEQ ID NO: 130821 - DNA, 6740 bp, Homo sapiens
  Payload ID: 5566
  Gene Symbol: ETV1
  Gene Name: ets variant 1
  Uniprot ID: P50549
  ENST ID: ENST00000430479
  CDS Start-End: 669-2102
gtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactgaaaat

SEQ ID NO: 130822 - DNA, 546 bp, Homo sapiens
  Payload ID: 5566
  Gene Symbol: ETV1
  Gene Name: ets variant 1
  ENST ID: ENST00000433547
  CDS Start-End: 487-546
agaggcgctttcggcttccaagggggaagtgctgggctataattaatgtttttattaaatttggagggaagtttttgcagcctttcgcctagcgtggccttcaggtgggtctttccaacaactttttatgtctctccagataattgcatggttgtgggtcgcaaaaactatcctgatgaaagaggtgtctccgtctctttagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggaga

SEQ ID NO: 130823 - DNA, 580 bp, Homo sapiens
  Payload ID: 5566
  Gene Symbol: ETV1
  Gene Name: ets variant 1
  ENST ID: ENST00000431887
  CDS Start-End: 295-580
aagctccgccccctcgcggttaccctggatacccgtcaggctcgggctgcagagaaggaggatcagggcaagtggcttcagagatgcagccctcactgcttaacgtcctagttattgtccttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccat

SEQ ID NO: 130824 - DNA, 6231 bp, Homo sapiens
  Payload ID: 5566
  Gene Symbol: ETV1
  Gene Name: ets variant 1
  Uniprot ID: P50549
  ENST ID: ENST00000420159
  CDS Start-End: 339-1598
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 130825 - DNA, 2050 bp, Homo sapiens
  Payload ID: 5566
  Gene Symbol: ETV1
  Gene Name: ets variant 1
  ENST ID: ENST00000443137
  CDS Start-End: 423-1526
aagtggcttcagagatgcagccctcactgcttaacgtcctagttattgtccttgaaacccgagccatctcaccgctcgcccccaaccctgggctctggctgtttaaaagctggagaggaagtgaaagcgtcaagtacatcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggtttttcaaatgttgccctttctgtaattattttaagaggtatatgtctctctactgaccataggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggc

SEQ ID NO: 130826 - DNA, 926 bp, Homo sapiens
  Payload ID: 5567
  Gene Symbol: ETV2
  Gene Name: ets variant 2
  ENST ID: ENST00000379023
  CDS Start-End: 440-907
gcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 130827 - DNA, 1571 bp, Homo sapiens
  Payload ID: 5567
  Gene Symbol: ETV2
  Gene Name: ets variant 2
  Uniprot ID: O00321
  ENST ID: ENST00000379026
  CDS Start-End: 440-1552
gcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaacattcagaaggccttcatcgcatccatggacctgtggaactgggatgaggcatccccacaggaagtgcctccagggaacaagctggcagggcttggtaggctgccgaggctgccacaacgtgtgtggggagggtgtccaggtggggcctctgctgaccctaaccccttatcgcctgcagaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 130828 - DNA, 1487 bp, Homo sapiens
  Payload ID: 5567
  Gene Symbol: ETV2
  Gene Name: ets variant 2
  Uniprot ID: O00321
  ENST ID: ENST00000402764
  CDS Start-End: 440-1468
gcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 130829 - DNA, 1335 bp, Homo sapiens
  Payload ID: 5567
  Gene Symbol: ETV2
  Gene Name: ets variant 2
  Uniprot ID: O00321
  ENST ID: ENST00000403402
  CDS Start-End: 307-1335
aggtgagcgatgaactgaggactagatgcctgggtgtctgggttaggaaggacctgggggactagactcccaagaagccgggggcctggactcctgggtctaacagaggaagagagctggggtccctcactcccaggaccaagattttaggctcctggggaaggagggagcggaggcctggactcctggctctgagggaagctagggctggggcccagactccagggcctccaagtgtcaccagctcacccattgccatctggacttttcccgacccagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataa

SEQ ID NO: 130830 - DNA, 1342 bp, Homo sapiens
  Payload ID: 5567
  Gene Symbol: ETV2
  Gene Name: ets variant 2
  ENST ID: ENST00000479824
  CDS Start-End: 574-1323
ctccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 130831 - DNA, 536 bp, Homo sapiens
  Payload ID: 5567
  Gene Symbol: ETV2
  Gene Name: ets variant 2
  ENST ID: ENST00000591135
  CDS Start-End: 1-288
cagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggggcagctcccctgcccagccaaatccgccccgtctcttctagttcaatttagctccgcccaagggctaggttcaaccgcgtagccctcggccccgccgctccccggcccactcgaggccccgcccaacccttctcaaacccaatctcccgcctgtactcctgcctcaaccaacccagtctccaccgggctctgcgaggcctcgcccaggtctgcactgcacaccgcccccaggcccggccctccccactatcgccaagccccgccccttcccactccgaccgagcgggcctctgtcctaggtggctcggctgtggggcgagcgcaagagaa

SEQ ID NO: 130832 - DNA, 994 bp, Homo sapiens
  Payload ID: 5567
  Gene Symbol: ETV2
  Gene Name: ets variant 2
  ENST ID: ENST00000619399
  CDS Start-End: 440-994
gcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaa

SEQ ID NO: 130833 - DNA, 941 bp, Homo sapiens
  Payload ID: 5567
  Gene Symbol: ETV2
  Gene Name: ets variant 2
  ENST ID: ENST00000621247
  CDS Start-End: 46-600
cagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgctccccgcccgcgcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 130834 - DNA, 1539 bp, Homo sapiens
  Payload ID: 5568
  Gene Symbol: ETV3
  Gene Name: ets variant 3
  Uniprot ID: P41162
  ENST ID: ENST00000326786
  CDS Start-End: 173-604
gggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtaagatacaaactcttttggtagggaattaattttgaattgaaaagaatttttaaaaatccaaatctaagacatggcatgtttaggaagattttagaaacactaaaataatgtgatcctttggattgcctcaatgttcttactcaagtcatctcacttataaggagagttataggctattcagtatcaagatagatttctttggtttatttggttggttcccttttctgcatattgtttgtaatctcctagatactattacgctatcttgtttgggaatgatgtttcataggtttgtgatgatctttacgttcaggactcagttttaacacccagcccagtggttctttcatagatgggaacctgtttctacaaacacttccgattttctgtgaaactaccaagctctcccttatcaagtgaatatcatcaaaaccacagcatccttgatcagagaagggggaggttcacatgtttgcagtgaaaagcagtgtctttgatctgcaacagcaaatcctcagagaaaaagattctggggttacttgaccttctctcctgttaagtgcagtagggcttcccctcttgactttcctggttatagctttccatcacagctccccacattctctcttgatgttgaaagcagtctctcaaaagactttgttgttgtgtggttttttgtttgtgatttttttccttatgcaaatcatactcctgcccaagaaaatacagtagttccccttatctgagcagtatatgttctaagacccctagtagattcgcaaaccacagatagtaccaaactccattcatatatatgatgttttttcttcccttaaccccactcatatgtatctgtgataacgtttaatttataaattaggcacagtaagagattaatgacaataataaaatagaaaaattataacaatatgctgtaataaacttaatgtggtctttctcaaaa

SEQ ID NO: 130835 - DNA, 5254 bp, Homo sapiens
  Payload ID: 5568
  Gene Symbol: ETV3
  Gene Name: ets variant 3
  Uniprot ID: P41162
  ENST ID: ENST00000368192
  CDS Start-End: 66-1604
ccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtgtggttcctcagagtgcaccaccagtgccaacagcctcttcccggttccatttcccacctctggacacccattctccaaccaatgatgtgcagccgggacggttctctgctagctccctaactgcttctggccaggagtccagtaatggtactgatagaaagactgagctttcagagctggaggatggctcagctgctgactggcgccggggtgtggatcccgtgtcctccaggaatgccattggtggaggagggattggccatcagaaacgcaagcctgacataatgcttcctctgtttgctaggccagggatgtaccctgacccccacagtcccttcgctgtctctccaatccctggccgcggaggtgtccttaatgtccccatttcaccagccctctccctgactcccaccatcttctcctatagcccatcaccaggcctgagccctttcaccagcagcagctgcttctccttcaaccctgaggaaatgaaacactaccttcattctcaagcttgttctgtgttcaactaccatctgagtcctcggacttttccccgttacccagggctcatggttccaccactgcagtgccaaatgcatcctgaggagtcaactcagttctccatcaagctgcagcccccaccagttgggcggaagaaccgggagagggttgagagcagcgaggagtcagcaccagtcaccacgcccaccatggcttctattcccccaagaatcaaggtggaacctgcctctgaaaaggatcctgagagcctcaggcagtcggcacgagagaaggaggagcacactcaagaagagggcactgtgccaagcaggaccattgaagaggaaaaaggcaccatctttgcccgtcctgctgcaccacccatctggccctctgtgcccattagcaccccaagtggagaacctctggaggtgactgaagacagtgaggataggcctggcaaagagcccagtgcacctgagaagaaagaagatgcactgatgccccccaagcttcggttgaagcggcgctggaatgatgaccctgaagcccgagagctgagcaagagtggcaagtttctctggaatgggtcaggaccccagggcttggcaacagcagctgctgatgcttagaactggaagtggattaggagctgtttatactataatcaaatacatacatgtatttatgtagcaagatttcagggtgggggggagggagttaaactggtttgatcattctaggggcatagacttgtatttttatgttttggggatgggatggggttatcttctgttgtaaattaggtgggatatgaacacacttattttcctggtgagtaggacacagggagggtattgaactcaaaggagaaggagcctctatttcctgttgaggcttatactttctgacaaggaaactcccaaagggccaagatactttttggtcccatgatagtcaggttccagacttctttcttttctattgtatttgtatgtggaaagccattaatgaatttattttactccaagagatacacataaaagggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaa

SEQ ID NO: 130836 - DNA, 1976 bp, Homo sapiens
  Payload ID: 5569
  Gene Symbol: ETV3L
  Gene Name: ets variant 3-like
  Uniprot ID: Q6ZN32
  ENST ID: ENST00000454449
  CDS Start-End: 286-1371
gtccgagtcagccctgggcagcggggaggtccccagagggggctgggccctgtctgggtatggggaagcttgctgcctctggttcccttttctccccttcactggcaacctcttgtcccttcccttttctctctttctttcctgaccctctcccttccttccttctttccctccatttttccttcctctttcactgtcctcccctctgcctccttccttcccttcctcttaagtggtgaccatttccccaaggcccagacacagcccatctcgccggagtggaccatgcactgcagctgcttggctgagggcatcccagccaaccccggcaactggatctcagggttggccttccctgattgggcctacaaagccgagtcgtccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatattactacaataagaggatcctgcataagaccaaaggcaaaaggttcacatacaagttcaacttcagcaagctcatcgtagtcaactatcctttgtgggaagtgcgggcgccgccatccccccacttgctgctgggggcccctgccctgtgtcggccagcgctggtgcccgtgggtgtgcagagtgagctcctgcacagcatgctatttgcccatcaggccatggtggagcagctgacaggacagcagaccccccgagggccaccagagacctctggggataagaaggggagcagcagcagcgtctaccgacttggctctgccccaggcccctgccggctgggcctttgctgccatttggggagcgtccaaggcgagctgcctggtgttgcctccttcactcctcccctcccgccccctctgccctccaactggacctgtctctcggggcccttcttgcctcctctcccgtcagagcagcagctcccaggggcttttaagccagacatcctgctcccaggacctaggagcctcccaggggcctggcattttccagggcttcctctcttggcagggctgggacagggtgcgggtgagaggctttggctcttgtccctcaggcccgaggggctggaagtaaagcctgctcccatgatggaggcaaagggaggcctggatcccagggaggtcttctgcccagagacccgcagactcaaaactggggaggaaagccttacttcccccaatctggagaacctcaaagcagtgtggcccttggatcctccttaactagagaggaaggtgggaagttggggaggagtcctccaaagtccatctctcctcttgcccaccgcctctgggttagccccttcccctggctggacatgggctgaaattgcaggatttgaaggggtggagttggacccaaggtggggagcattgcagggaaggtgtgaatgtggaaatgggaaaaaccaagacagggtgcccctcctctttcaccatattgctaagcagactaaggggacattcctaatctcaacttttcttcagggagacgagaataaagtttctataatttccatcctgcccacataagggggaaaattaagggtctagcctggggagaggacaggggtggttgtgttccctgagtcttgtctggggcccatctccccattccaggctaaggtctccagtccctttctcacccctccatgcaacttctctcccatccctctgatttctgagaccctggaaacccctgtcccatgcaggcacttcctcctctctccatttccccaggacccaggcaagtggggtggggagacactggccttctctgctctgtaatactccactgtgaccatgaataaaatgcccttgcaaactgt

SEQ ID NO: 130837 - DNA, 2429 bp, Homo sapiens
  Payload ID: 5570
  Gene Symbol: ETV4
  Gene Name: ets variant 4
  Uniprot ID: P43268
  ENST ID: ENST00000319349
  CDS Start-End: 300-1754
gaaacaaagggaaacggggggcggtgtggcggggcggggggtggagagctgaggccgagcgaaggaaatgcaccaatcagctgctcccccgggctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 130838 - DNA, 2182 bp, Homo sapiens
  Payload ID: 5570
  Gene Symbol: ETV4
  Gene Name: ets variant 4
  Uniprot ID: P43268
  ENST ID: ENST00000393664
  CDS Start-End: 55-1509
caggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctccca

SEQ ID NO: 130839 - DNA, 1775 bp, Homo sapiens
  Payload ID: 5570
  Gene Symbol: ETV4
  Gene Name: ets variant 4
  Uniprot ID: P43268
  ENST ID: ENST00000545954
  CDS Start-End: 197-1534
gcgcccgaaaaacaagtcggtgcgctggggacccggggccggggccgccttactccggcctagccccgcggccctcggtgcgggctccagggcatgctcgggaccccccgcggctccagcccagacgccccggcctcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctgg

SEQ ID NO: 130840 - DNA, 1628 bp, Homo sapiens
  Payload ID: 5570
  Gene Symbol: ETV4
  Gene Name: ets variant 4
  ENST ID: ENST00000545089
  CDS Start-End: 97-1389
agccctccctggacggtgtgcgaacgcagccccctcccccaccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccct

SEQ ID NO: 130841 - DNA, 2147 bp, Homo sapiens
  Payload ID: 5570
  Gene Symbol: ETV4
  Gene Name: ets variant 4
  Uniprot ID: P43268
  ENST ID: ENST00000538265
  CDS Start-End: 135-1472
cacgttcttatgtaaccgagcccgggtaaagcagggctgcagaaagcagaaacggcgagcccggctcctgggagcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 130842 - DNA, 1727 bp, Homo sapiens
  Payload ID: 5570
  Gene Symbol: ETV4
  Gene Name: ets variant 4
  Uniprot ID: P43268
  ENST ID: ENST00000591713
  CDS Start-End: 91-1545
gcagaaagcagaaacggcgagcccggctcctgggagcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagt

SEQ ID NO: 130843 - DNA, 581 bp, Homo sapiens
  Payload ID: 5570
  Gene Symbol: ETV4
  Gene Name: ets variant 4
  ENST ID: ENST00000586764
  CDS Start-End: 498-581
aaggaagcagtgaggggaacagacgagctccacacacaaagggacgggaggagagggatagacacaaagcctgctagaggtgatcagggaaggcttcacagaggaggcagtatcagtcccagcaactgtagcccagttgctccccgtcacccaaagacagccacacctgatcccctggctcaggcagctggaaagaggagctgagaaaaaggagagtcatgctctcagcaaacatcaagtgctgtaagcatcataaaatcatcatcatcatcatcaccatcagacactgatggcccagtgggaggcctgggaccctgaagagagcccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaa

SEQ ID NO: 130844 - DNA, 917 bp, Homo sapiens
  Payload ID: 5570
  Gene Symbol: ETV4
  Gene Name: ets variant 4
  Uniprot ID: P43268
  ENST ID: ENST00000586826
  CDS Start-End: 274-897
cttgcccagcccccgctgctgccttccatggcctcagccgcagccctcaagttgaggaggggttccagcatcacactccctctgggtgaactttccctgggattttgtggttggcaggcaacctgggcaaagaacagtcaccaggaagcaggctggaaggaagaaattcttgaatgtggataggacttcctcctcccctgccctcgagctccaccccaagccacttctcacatcaccccttcttcccccacagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccc

SEQ ID NO: 130845 - DNA, 4111 bp, Homo sapiens
  Payload ID: 5571
  Gene Symbol: ETV5
  Gene Name: ets variant 5
  Uniprot ID: P41161
  ENST ID: ENST00000306376
  CDS Start-End: 248-1780
agcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagcacccgaa

SEQ ID NO: 130846 - DNA, 564 bp, Homo sapiens
  Payload ID: 5571
  Gene Symbol: ETV5
  Gene Name: ets variant 5
  ENST ID: ENST00000422039
  CDS Start-End: 169-564
ctccgcagttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacccatttcttttcaaacttcctcaagagttcatgatcccttttcaattccaatttgttgccatcctttatagtcctgggtctctgtcatcatttagcaagtcagctgtgcaaagtggtgcttcatgccccacctccaaccaagatcaaacgggagctgcacagccc

SEQ ID NO: 130847 - DNA, 574 bp, Homo sapiens
  Payload ID: 5571
  Gene Symbol: ETV5
  Gene Name: ets variant 5
  ENST ID: ENST00000440773
  CDS Start-End: 125-574
agcatccccggagagaagatagagccgccccacggccttcacaggagggggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctattt

SEQ ID NO: 130848 - DNA, 366 bp, Homo sapiens
  Payload ID: 5571
  Gene Symbol: ETV5
  Gene Name: ets variant 5
  ENST ID: ENST00000433149
  CDS Start-End: 1-268
tgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatg

SEQ ID NO: 130849 - DNA, 573 bp, Homo sapiens
  Payload ID: 5571
  Gene Symbol: ETV5
  Gene Name: ets variant 5
  ENST ID: ENST00000413301
  CDS Start-End: 177-573
tttgcgggggcaggggggagatcggaaggggcgtccggccactggtccgacaggcccagccggctagagttcacgggctgattcagaatcttcaaagtcggggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagc

SEQ ID NO: 130850 - DNA, 554 bp, Homo sapiens
  Payload ID: 5571
  Gene Symbol: ETV5
  Gene Name: ets variant 5
  ENST ID: ENST00000421809
  CDS Start-End: 135-554
gtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaaccccc

SEQ ID NO: 130851 - DNA, 2213 bp, Homo sapiens
  Payload ID: 5571
  Gene Symbol: ETV5
  Gene Name: ets variant 5
  Uniprot ID: P41161
  ENST ID: ENST00000434744
  CDS Start-End: 294-1826
ggagcgcgagtgcgggggctcccgagtggatgggggatcgcggagttgcgaggctttcacagtctctggagattcgagagccccgaggggacttggaggctcgcgagaagagacgcttggcggagctccgcagttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaa

SEQ ID NO: 130852 - DNA, 160 bp, Homo sapiens
  Payload ID: 5572
  Gene Symbol: ETV6
  Gene Name: ets variant 6
  ENST ID: ENST00000266427
  CDS Start-End: 1-151
catgacctatgagaaaatgtccagagccctgcgccactactacaaactaaacattatcaggaaggagccaggacaaaggcttttgttcaggttcctctttttcctgccacgtggatcaggtctgttcctgttactgttgggtcttggctgaaaaaaaaaa

SEQ ID NO: 130853 - DNA, 5989 bp, Homo sapiens
  Payload ID: 5572
  Gene Symbol: ETV6
  Gene Name: ets variant 6
  Uniprot ID: P41212
  ENST ID: ENST00000396373
  CDS Start-End: 275-1633
gcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaagcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaa

SEQ ID NO: 130854 - DNA, 652 bp, Homo sapiens
  Payload ID: 5572
  Gene Symbol: ETV6
  Gene Name: ets variant 6
  ENST ID: ENST00000545027
  CDS Start-End: 1-267
tcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaa

SEQ ID NO: 130855 - DNA, 1719 bp, Homo sapiens
  Payload ID: 5573
  Gene Symbol: ETV7
  Gene Name: ets variant 7
  Uniprot ID: Q9Y603
  ENST ID: ENST00000340181
  CDS Start-End: 243-1268
gtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 130856 - DNA, 1530 bp, Homo sapiens
  Payload ID: 5573
  Gene Symbol: ETV7
  Gene Name: ets variant 7
  Uniprot ID: Q9Y603
  ENST ID: ENST00000339796
  CDS Start-End: 26-979
ggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagaaatggacttcagctgatcttcatattcatatggagtttccagtgaccccaaatagccaaaacagtcttggaaagaaaaacaaagttggaggacccacacttcctgattttgaaacttgctacaaagctatagtactcaacaaagattggtaatggcataaggatatagattaagaacagttttttcaacaaatagtgttgggacaatgggtgtccacatgcaaaagaataaagttgtccccttaccttacaccatctccaaaaattaactcaaaatatgtcaaagacataaacgtaagagctaaaactgtaaaactcctagaataaaacataggagtaaatcttcatgaccttggattaggccattgtgtcttaaatataacaccaaaagaataagtaataaaaaaatagataaattgaactccatcaaaattaaaagcctttgtgcttcataggacaccatcaagaaagtaaaaaaaaaaaaaaaaacccataggatgggagaaaatatctccaaatcatatatctgataaaagaattgtatccaggattgataaagaattcctacaactcaataataaaaagacaaaaaacccc

SEQ ID NO: 130857 - DNA, 1488 bp, Homo sapiens
  Payload ID: 5573
  Gene Symbol: ETV7
  Gene Name: ets variant 7
  Uniprot ID: Q9Y603
  ENST ID: ENST00000373737
  CDS Start-End: 243-1037
gtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 130858 - DNA, 1570 bp, Homo sapiens
  Payload ID: 5573
  Gene Symbol: ETV7
  Gene Name: ets variant 7
  Uniprot ID: Q9Y603
  ENST ID: ENST00000373738
  CDS Start-End: 260-1120
cccgctctttcgttttcgtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 130859 - DNA, 1434 bp, Homo sapiens
  Payload ID: 5573
  Gene Symbol: ETV7
  Gene Name: ets variant 7
  Uniprot ID: Q9Y603
  ENST ID: ENST00000538992
  CDS Start-End: 412-984
cccgctctttcgttttcgtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 130860 - DNA, 1776 bp, Homo sapiens
  Payload ID: 5573
  Gene Symbol: ETV7
  Gene Name: ets variant 7
  Uniprot ID: Q9Y603
  ENST ID: ENST00000615781
  CDS Start-End: 478-1326
cccgctctttcgttttcgtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtcagggaaacgcacaggctttcctctaagcgggaaccctggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 130861 - DNA, 1599 bp, Homo sapiens
  Payload ID: 5573
  Gene Symbol: ETV7
  Gene Name: ets variant 7
  Uniprot ID: Q9Y603
  ENST ID: ENST00000620358
  CDS Start-End: 367-1149
cccgctctttcgttttcgtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 130862 - DNA, 1285 bp, Homo sapiens
  Payload ID: 5573
  Gene Symbol: ETV7
  Gene Name: ets variant 7
  Uniprot ID: Q9Y603
  ENST ID: ENST00000627426
  CDS Start-End: 76-864
gcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagaaatggacttcagctgatcttcatattcatatggagtttccagtgaccccaaatagccaaaacagtcttggaaagaaaaacaaagttggaggacccacacttcctgattttgaaacttgctacaaagctatagtactcaacaaagattggtaatggcataaggatatagattaagaacagttttttcaacaaatagtgttgggacaatgggtgtccacatgcaaaagaataaagttgtccccttaccttacaccatctccaaaaattaactcaaaatatgtcaaagacataaacgtaagagctaaaactgtaaaactcctagaataaaacataggagtaaatcttcatgaccttggattaggccattgtgtcttaaatataacaccaaaagaataagtaataaaaaaatagataaattgaactccatcaaaattaaaagcctttgtgcttcataggacaccatcaag

SEQ ID NO: 130863 - DNA, 2698 bp, Homo sapiens
  Payload ID: 5574
  Gene Symbol: ERF
  Gene Name: Ets2 repressor factor
  Uniprot ID: P50548
  ENST ID: ENST00000222329
  CDS Start-End: 159-1805
attaacccgggaggcggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggaccttt

SEQ ID NO: 130864 - DNA, 2032 bp, Homo sapiens
  Payload ID: 5574
  Gene Symbol: ERF
  Gene Name: Ets2 repressor factor
  Uniprot ID: P50548
  ENST ID: ENST00000440177
  CDS Start-End: 303-1724
gtgcggggcgggggggctcgtccaccgggcccgctatccctggttctgcgctgcgcggtcctgctggtgaccttcacggcggcgcgtgccctgcaccagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattga

SEQ ID NO: 130865 - DNA, 264 bp, Homo sapiens
  Payload ID: 5574
  Gene Symbol: ERF
  Gene Name: Ets2 repressor factor
  ENST ID: ENST00000598965
  CDS Start-End: 80-264
gggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctggtgctgtcccccaccgaggacccccgctcaccaccag

SEQ ID NO: 130866 - DNA, 555 bp, Homo sapiens
  Payload ID: 5574
  Gene Symbol: ERF
  Gene Name: Ets2 repressor factor
  ENST ID: ENST00000593944
  CDS Start-End: 262-555
gtttccttcccccggcggcggcggcggcggcggcggcggctcgggctcctgtgtgcggggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttc

SEQ ID NO: 130867 - DNA, 2707 bp, Homo sapiens
  Payload ID: 5575
  Gene Symbol: EHMT1
  Gene Name: euchromatic histone-lysine N-methyltransferase 1
  Uniprot ID: Q9H9B1
  ENST ID: ENST00000462484
  CDS Start-End: 38-2464
gcgcgggaggggcggggccacgctgcgggcccgggccatggccgccgccgatgccgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcagttctgcaggctgggaagcccaaggtcgaggggctgcctttggtgacttatggtgaggacctcgtgctgttcccgaacacagccaggaaccacgccaagaggaagatgctccagcacagccttgctgtggaccaggccgcccacagggagcaggtccattcctgggggctgactccgcctttcagagaggcgtggctccatcttcacagcctcgtagcctcttaaaggcccagcctcaaaacctcattggggcccccagccccggtaaataaattgcattcagaccata

SEQ ID NO: 130868 - DNA, 5137 bp, Homo sapiens
  Payload ID: 5575
  Gene Symbol: EHMT1
  Gene Name: euchromatic histone-lysine N-methyltransferase 1
  Uniprot ID: Q9H9B1
  ENST ID: ENST00000460843
  CDS Start-End: 67-3963
gggccgcgaggcgcgggcggggcgatggcgcgcgggaggggcggggccacgctgcgggcccgggccatggccgccgccgatgccgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttaaa

SEQ ID NO: 130869 - DNA, 7842 bp, Homo sapiens
  Payload ID: 5575
  Gene Symbol: EHMT1
  Gene Name: euchromatic histone-lysine N-methyltransferase 1
  ENST ID: ENST00000462942
  CDS Start-End: 1-2412
atgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataagatctcctcggcttagcagctgaagactgacgctgcctgatcgcatcccctaggaagccccctggatcatcacggacgccgagcttcgggtaactcttatggtggagggggaaaacgtccagaaacaaatgaatcctcaggtctggaactcaggagaagactctggactgagctatggatctggaaactcctgaacagagcagtggttccaagctggagacgattttgcacctgggggacgtctgcaaggtctggagacagtttgggttgtcacaaccgaaggagtgctatggcacttagtgggatcaggcagggatgttgttaaacactgtacagtgcacaggacagccctccccaacagagttcctggaccgtacatgttaatggtgctggggctgagaggccactgatggactcgtggagctggcgaggcggccctggagtctgtggcctgtgagggaagcgggaacctctgagggagtgcagcgttcagcagcatccacccatccagccacgaggcctggcagaggggtgggagaggaggtggacctgccgtagaccccacaagcctgtcaaggagctgggacttggagtgaaaaggagagcgacgtggtcagaactgtgccttagaaagaccactctggacacagagagggggctggggagaggcgagggctgcatggtgctgtggctgcctgctggaatggcaggctaggccattgtgggcagcagtgagggaaggggtgattcgggagctggaagaggcaggacagggcaacgggctggacttgatgggtgagagaagctagtgacctttggcatgtagcaaacagttctcatgccctgccaccagcatcatgccagggcaggctgggctctcaccctcacagaatgtcccatgaataattatgtaactaaaagtgctgtgtgttgcaggtagcaactaaccggggctggtggcgtgggcagtaaaaagaatttaccaagactgttgtaggtaaagaaaggcagatttatgagagaaagtaggaaaatacgttgcaagaaagcaatgggcaatcaccaagagaggcgctggcagcaagagctgaaggcgtgctggggattttataggatggggcttgtgccggagagggccatgtgcagtgctgataacgcccaggttgcagggagctaacgcgtttttctatcagccgaggatctggtgataactgggcgtaggaagattgtgatttgtctgcacgggagggccgtgtgtcctggaccatgaagaaaggcagactcacagcttctccgctctctctgttgctttcccctggtcccaccagtctgactcctttccctcattaggactccgcagcatggacaccatgaagggaggcagagcctgtgacaggaacgctcagccagggaggcttctctgatgagggccagagctgtccaggccaggcctggggggacagacgcacattcacgttcaaggttttatttgaacatggtttcaatgaatcctctcaatgttttgaaattgcaacttagtttcagtcgtctacaaaacctttgctcccccgtagcagcaccccctttatgttgttattatcacaaattacatcttgacacactgggccaccagcaggacttataattattgtaataggcagttgtctctttaaattgcaaggcacttacagcgaaggtgcctgcatgctccctctagtcccccagggaagcagcccgagcccctgggaagggccaggtattaacttgccagacatcgcagctcattccaggctcccagccactcttccgtcagtggattccaattctgaaaatcggctcatgtccagaaacagcacgggagtgtgacttcctgctggggcagcccctcagcccctgccctctgttgactcttacatgtgaagcttcccccttgttggccactggtttcacccctcagggcaccgtgctctgttaccaccccctgttactgcccccaagcccctcggtggccgcctgcctcatcttccccacggggattagggagcccggctctgtagctgcgtctcccatcatcagcacaggctgcagagggggaacccctcgactctcccaccctcagcacaggctgcagatggggaacccctcaactctcccaccctcagcacaggctgcagacggggaacccctcgactctcccaccctcagcacaggctgcagagggggaacccctcgactctcccaccctcagcacaggctgcagacggggaacccctcgactctcccaccctcagcacaggctgcagacggggaacctcttgactctcccaccctcagcacaggctgcagacggggaatgcctcgacttcctggtgatgctggtgttctccctagggcttcctgcacacccacctccctccaccccattccttcctctaccagctgtcagagaacttgagggtttctgcttcactgtgagctggctaccacttttttcaaggcttttaagagccattccaagttttccccacctcctgggtcctgagaaagtgccccactgcagcaaatgcttccagacccttggtcaagctcctcactctcccatcccgggacttctcttctgccccagctgaggccatcaaccagttcttgcaattacttagctgtgcagcccctttctccctttttaggcttagcaccctgccccttcccgttggtctgtgctgggatttagccctcgcaattggcctggcaggcaggtgggacagctcctgaggcgagcacttgcttcctggtgagacaggtgattccgtaacatctccagcacagtagatgtgctcacctttatggggcaggaggacctgtgcacttccagaggttccagaggactggagggtcctcatcgttacatctttgggacccagattttccccaggggacccttactttctacctttgcagagctgacccaccggtggcccttcactctggttaagtgcctgtttacctctgtggtagaggcactccagtctcacaccgagcttggtaacagttctcaggatgtcggtatggggaaccagcccgctgtcctgtctttgttggtttggttgctccccactcccagtttttcaggggcctgcatcatcccaccagccacagcgctgtgctccaccgagatattttcccaggtcatcactcatgaagctcccaccgtgtgccagggaccaccggacctcccagccaaccaggacagcagcctctgcaccctttgggtggtgggcaggacagtcccagatcctctcctgatgccacttatgttagtccaggtcttccaagatgcagatgggataaaggtataaggatttggttagattttattagatgatgaaggctgagtgtggtggctcgtgcctgtaatcccagcactttgagaggccaaggtgggcagatcacttgaactcaggagttcgaggccagcctgggcaacatggtgaaacaccgtctcaacaaaaacaaacaaacaaaaattagcctggcatggtggtgtgtgcctgtagtccttgctacctgggaggctggaatgggagggttgcttgagtccaggaggtggaggttgcagtgagccgagatcatgcccctgtactgcagcctaggtgatgggaatgaagccctttcaaaaaaagagagaagattttattagatgatgaagattagatattgttgttattattagagatgaagcatggaggtagctaagaaacttggaagagcttcagaatgtgagtagctctaacttccagagaggaagagagggaacgaaggttgactgggagtgacctagatcactaaacaacctaaggaaggttcaggaaagctgccagggagttcttgagccaaagaagtgtggcctcagcacaaatgcagagacagattctgagcacaagagctgaggccattggtcatgacattcccatagttggaggcctatgaagcacactttcaaggaaactgcaactgtttaaaataacagtaatgtcctatgtgtgttttttttaaaagaaaggctgaaagttaattagctcatcatccacccgaagaagcaaaatcaacctaaaacaagaggtataaagagaagcactaattagatagaaactaacatgcactggagacaatcaaaccaaaactggttctttggcaacactaatcagaatggcaaccctctgggcaggtggggaagggggagcataaataaacaatttaaaggtaggccaggtgcagtggctgacacctgtaatcccagcactttgggaggctgaggtgggaggatcacttgagcccaggagttggagaccagcctgggcaacatagcaagaccctgtctctggaaaaaatttaaaaactagctggacatggtggcatgcacctgtgatcccagctactcgggaggctgaggtgggaggctggcttgagcctgggaggttgaggctgcagtgagctgagattctaccactgcagtccagtctgggtgacagagcaagaccatgtctcaataaataaataaataaataaataaataaataaagtggacacagccatagatataacatagatttaaaagataatatgaacaattttaggccaatacatttctagaaaaatataactgcactaacactgactcaagaggaaatagagaacccgaatagtcttataactcttaaagagatagaatcagtaattaaaatcacaaacaaaacatcaggcccagtcagtgagttccactgaactttcaaaatataaattccctatagaaatgctctctaactcatttacaaggctagcataacctggatatccaaacctgatgagaatagtgcagtgcacagctgcaaaaagtctagacaagttattggtaaaccagatctgaattgtacgcaaagatgattatgtttgatttaccccaggaatgacaggttggtttaactttaggaaatcagtttatgtaagccattcccttaacacatagaaggagaaaaattaggtcatttcaatgcagaaaaagcatttgacagaatttatcacctattcgtgagaaaaactcctagaaattaagactagaggggaactttgtgacctgatgaacggtatcttttgaacaaaaaaaaaaagaacaggcctggcgcagtggctcatgcctgtaatcccagcactgtgggaggccaaggtgggcagatcaccctgaggtcagtagttcaagaccaacatggcaaaaccccatctctactaaaaatacaaaaattagccaggtgtggtggcacgcgcctataatcccagctactcaggaggctgagacaggagaattgcttgaacctgggaggtggtggaggttgcagtgagctgagatagtgccactgcacttcagcctgggcaacagatcgagatttcgtct

SEQ ID NO: 130870 - DNA, 558 bp, Homo sapiens
  Payload ID: 5575
  Gene Symbol: EHMT1
  Gene Name: euchromatic histone-lysine N-methyltransferase 1
  ENST ID: ENST00000626216
  CDS Start-End: 239-558
ggccacgctgcgggcccgggccatggccgccgccgatgccgagataggtggtcttgctctgtggccctgctggagtgcagtggtgccatcatggctcacttcagtcttgaactcctgagctcaagtgatcctcctacttcagcctcctgagtagctgggactacaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgag

SEQ ID NO: 130871 - DNA, 1297 bp, Homo sapiens
  Payload ID: 5575
  Gene Symbol: EHMT1
  Gene Name: euchromatic histone-lysine N-methyltransferase 1
  ENST ID: ENST00000626066
  CDS Start-End: 1-1297
tgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgc

SEQ ID NO: 130872 - DNA, 709 bp, Homo sapiens
  Payload ID: 5575
  Gene Symbol: EHMT1
  Gene Name: euchromatic histone-lysine N-methyltransferase 1
  ENST ID: ENST00000630754
  CDS Start-End: 298-709
gcggggccacgctgcgggcccgggccatggccgccgccgatgccgagactgtgttgatcaggctggttgaactcctgggctcaagcaatcttcccgctgccatatgaatatgaatatgtgcacacccgtggttccagctactcaggaggctgaggtgggaggatcacgagcctgggagttcgaggctgcggtgagctgtgattgcaccactgcactccagcctgggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttc

SEQ ID NO: 130873 - DNA, 2679 bp, Homo sapiens
  Payload ID: 5575
  Gene Symbol: EHMT1
  Gene Name: euchromatic histone-lysine N-methyltransferase 1
  Uniprot ID: Q9H9B1
  ENST ID: ENST00000371394
  CDS Start-End: 37-237
cgcgggaggggcggggccacgctgcgggcccgggccatggccgccgccgatgccgagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaagatacagaaaacttctaaagtttatacggagtctcaagagacccagagaagccaaacaattttgtgaaagaacagagttggagaactcacacttgctgatttcaaaacttactatatacggccacagtaatgaaaacagtgtgggactggcataaagacagaaatagagaccaatggaataaaataaaaagcccagaaataaa

SEQ ID NO: 130874 - DNA, 689 bp, Homo sapiens
  Payload ID: 5575
  Gene Symbol: EHMT1
  Gene Name: euchromatic histone-lysine N-methyltransferase 1
  ENST ID: ENST00000629808
  CDS Start-End: 1-689
tgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatc

SEQ ID NO: 130875 - DNA, 781 bp, Homo sapiens
  Payload ID: 5575
  Gene Symbol: EHMT1
  Gene Name: euchromatic histone-lysine N-methyltransferase 1
  ENST ID: ENST00000486164
  CDS Start-End: 1-326
ccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgtaggctgcatatattcaaagtacacacttgggtgaattttcacccagaagccattgttgctgtcggaagagtgagcccagtcctccctcatgccctgatgatcttcaggaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcg

SEQ ID NO: 130876 - DNA, 503 bp, Homo sapiens
  Payload ID: 5575
  Gene Symbol: EHMT1
  Gene Name: euchromatic histone-lysine N-methyltransferase 1
  ENST ID: ENST00000465566
  CDS Start-End: 1-503
tggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaaggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgac

SEQ ID NO: 130877 - DNA, 1182 bp, Homo sapiens
  Payload ID: 5575
  Gene Symbol: EHMT1
  Gene Name: euchromatic histone-lysine N-methyltransferase 1
  ENST ID: ENST00000493484
  CDS Start-End: 114-437
agagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacagggttccagaggccagaaatgggaagtccagccacaaataaacccactaaattgataataagaaagaagatttgacacagaaaaagaagatttctaaaagcacactattaaatctccaatgtgctgaagtctggtgtctgaggagggagggctgacacttcctctcagagcttgagaacggcgtgggcacgggcccttgccattcattgttggcacggggaggtctgcatttggaacccctcgctgcatgtaagcagaccccacctcccacctagaaacagggaccactggctgtgggcacccgctgcctccctgcaggcacgcaggcctctctggagtgactggtcctgagctgcagtgcctcctccgtgggctgcagggcttccatgactgtatccagggggtttctacctcattccaccggagttctttcccactgcgggttaggatgacggcaccatgaagagaggagccctgagccggcagaaggaagagaagagggaagcagaggagccctgagctggtggaaggctgtggcgggtaccttggaggaagagaggagggaagcaaaggcagagaacaaggcagaggccacccccaggtggggccacctcacccaccgcccccggagactgcgtggcggggaaggcggccctagtgtggctggtcggcctgcatgcctgggcagtttgcagcctgtccaggtgtcagagctgttagctctctgatgctggtggctgttcccccagaatggaagcattgattaaatttcaagtttgttattta

SEQ ID NO: 130878 - DNA, 710 bp, Homo sapiens
  Payload ID: 5575
  Gene Symbol: EHMT1
  Gene Name: euchromatic histone-lysine N-methyltransferase 1
  ENST ID: ENST00000492232
  CDS Start-End: 294-710
agctctgaggaaactccagctcagcgcacagcatgaggaggacgagggaacaatagggcgttcctttgtgcctgcccttgaaacgcggtggaggccactcagtgagcccgggcagtgccatcgctcacgtgtccccagcagcagtggcgtctgtggggatgctgtgcactggaaattggcactgttttgggtagtggttctgagaggaactgtttaaccaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccag

SEQ ID NO: 130879 - DNA, 691 bp, Homo sapiens
  Payload ID: 5575
  Gene Symbol: EHMT1
  Gene Name: euchromatic histone-lysine N-methyltransferase 1
  ENST ID: ENST00000482340
  CDS Start-End: 67-420
caggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgatgacggcaccatgaagagaggagccctgagccggcagaaggaagagaagagggaagcagaggagccctgagctggtggaaggctgtggcgggtaccttggaggaagagaggagggaagcaaaggcagagaacaaggcagaggccacccccaggtggggccacctcacccaccgcccccggagactgcgtggcggggaaggcggccctagtgtggctggtcggcctgcatgcctgggcagtttgcagcctgtccaggtgtcagagctgttagctctctgatgctggtggctgttcccccagaatggaagcattgattaaatttcaagtttgttatttataca

SEQ ID NO: 130880 - DNA, 882 bp, Homo sapiens
  Payload ID: 5575
  Gene Symbol: EHMT1
  Gene Name: euchromatic histone-lysine N-methyltransferase 1
  ENST ID: ENST00000629417
  CDS Start-End: 479-882
agagatggggtttcaccatgttggccaggctggtcttgaactcctgacttcaaatgatccacccgcctcggcctcccaaagtgctgagattacaggcgtgagccaccgcgcccggccattacgcctgactaattttttttgtatttttagtagagagagggtttcaccgtgtcagccaggatggtcttgatctcctgacctcgtgatctgcctgcctcggccctgcaaagtgctgggattacaggcgtgagccaccgcgcccggcctatattttatttttttagacagggtctcactctgttgcccaggctggagtgcagtggcgcgatctctgctcgctgcaacctccgcctcccgggttcaggtgatcctcctgcctcagcctctgaagtagccgggactacaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaag

SEQ ID NO: 130881 - DNA, 818 bp, Homo sapiens
  Payload ID: 5575
  Gene Symbol: EHMT1
  Gene Name: euchromatic histone-lysine N-methyltransferase 1
  ENST ID: ENST00000460486
  CDS Start-End: 14-818
tttggagttgaaaatgttgtacttttctaggagccatttccccaggccatgtggaggtcaggtatctgctggttctggcctcactctactcctcctcctcctccccgctctgtggagagggtggcttgaaggagacgggcagcaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataagg

SEQ ID NO: 130882 - DNA, 4047 bp, Homo sapiens
  Payload ID: 5576
  Gene Symbol: EHMT2
  Gene Name: euchromatic histone-lysine N-methyltransferase 2
  ENST ID: ENST00000375528
  CDS Start-End: 21-3722
ctcttctctcggccccagagatgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130883 - DNA, 3856 bp, Homo sapiens
  Payload ID: 5576
  Gene Symbol: EHMT2
  Gene Name: euchromatic histone-lysine N-methyltransferase 2
  Uniprot ID: Q96KQ7
  ENST ID: ENST00000375530
  CDS Start-End: 1-3531
atggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130884 - DNA, 3965 bp, Homo sapiens
  Payload ID: 5576
  Gene Symbol: EHMT2
  Gene Name: euchromatic histone-lysine N-methyltransferase 2
  Uniprot ID: Q96KQ7
  ENST ID: ENST00000375537
  CDS Start-End: 8-3640
agcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130885 - DNA, 3856 bp, Homo sapiens
  Payload ID: 5576
  Gene Symbol: EHMT2
  Gene Name: euchromatic histone-lysine N-methyltransferase 2
  Uniprot ID: Q96KQ7
  ENST ID: ENST00000383372
  CDS Start-End: 1-3531
atggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130886 - DNA, 3980 bp, Homo sapiens
  Payload ID: 5576
  Gene Symbol: EHMT2
  Gene Name: euchromatic histone-lysine N-methyltransferase 2
  Uniprot ID: Q96KQ7
  ENST ID: ENST00000383373
  CDS Start-End: 23-3655
tcggcccccagcgcaagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130887 - DNA, 4129 bp, Homo sapiens
  Payload ID: 5576
  Gene Symbol: EHMT2
  Gene Name: euchromatic histone-lysine N-methyltransferase 2
  ENST ID: ENST00000395728
  CDS Start-End: 1-3804
atgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130888 - DNA, 4129 bp, Homo sapiens
  Payload ID: 5576
  Gene Symbol: EHMT2
  Gene Name: euchromatic histone-lysine N-methyltransferase 2
  ENST ID: ENST00000400006
  CDS Start-End: 1-3804
atgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130889 - DNA, 4047 bp, Homo sapiens
  Payload ID: 5576
  Gene Symbol: EHMT2
  Gene Name: euchromatic histone-lysine N-methyltransferase 2
  ENST ID: ENST00000400008
  CDS Start-End: 21-3722
ctcttctctcggccccagagatgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130890 - DNA, 4047 bp, Homo sapiens
  Payload ID: 5576
  Gene Symbol: EHMT2
  Gene Name: euchromatic histone-lysine N-methyltransferase 2
  ENST ID: ENST00000427405
  CDS Start-End: 21-3722
ctcttctctcggccccagagatgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130891 - DNA, 3965 bp, Homo sapiens; identical to SEQ ID NO: 130884
  Payload ID: 5576
  Gene Symbol: EHMT2
  Gene Name: euchromatic histone-lysine N-methyltransferase 2
  Uniprot ID: Q96KQ7
  ENST ID: ENST00000450075
  CDS Start-End: 8-3640

SEQ ID NO: 130892 - DNA, 894 bp, Homo sapiens
  Payload ID: 5576
  Gene Symbol: EHMT2
  Gene Name: euchromatic histone-lysine N-methyltransferase 2
  ENST ID: ENST00000447162
  CDS Start-End: 1-894
gagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccagggccagctgcccccaccctcactcccttcccacccacaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacat

SEQ ID NO: 130893 - DNA, 894 bp, Homo sapiens; identical to SEQ ID NO: 130892
  Payload ID: 5576
  Gene Symbol: EHMT2
  Gene Name: euchromatic histone-lysine N-methyltransferase 2
  ENST ID: ENST00000419454
  CDS Start-End: 1-894

SEQ ID NO: 130894 - DNA, 3965 bp, Homo sapiens
  Payload ID: 5576
  Gene Symbol: EHMT2
  Gene Name: euchromatic histone-lysine N-methyltransferase 2
  Uniprot ID: Q96KQ7
  ENST ID: ENST00000420336
  CDS Start-End: 8-3640
agcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130895 - DNA, 4129 bp, Homo sapiens; identical to SEQ ID NO: 130887
  Payload ID: 5576
  Gene Symbol: EHMT2
  Gene Name: euchromatic histone-lysine N-methyltransferase 2
  ENST ID: ENST00000420930
  CDS Start-End: 1-3804

SEQ ID NO: 130896 - DNA, 4129 bp, Homo sapiens; identical to SEQ ID NO: 130887
  Payload ID: 5576
  Gene Symbol: EHMT2
  Gene Name: euchromatic histone-lysine N-methyltransferase 2
  ENST ID: ENST00000436403
  CDS Start-End: 1-3804

SEQ ID NO: 130897 - DNA, 3094 bp, Homo sapiens
  Payload ID: 5576
  Gene Symbol: EHMT2
  Gene Name: euchromatic histone-lysine N-methyltransferase 2
  ENST ID: ENST00000425250
  CDS Start-End: 1-2769
tctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130898 - DNA, 3856 bp, Homo sapiens
  Payload ID: 5576
  Gene Symbol: EHMT2
  Gene Name: euchromatic histone-lysine N-methyltransferase 2
  ENST ID: ENST00000454705
  CDS Start-End: 1-3531
atggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130899 - DNA, 3856 bp, Homo sapiens; identical to SEQ ID NO: 130883
  Payload ID: 5576
  Gene Symbol: EHMT2
  Gene Name: euchromatic histone-lysine N-methyltransferase 2
  Uniprot ID: Q96KQ7
  ENST ID: ENST00000450229
  CDS Start-End: 1-3531

SEQ ID NO: 130900 - DNA, 4047 bp, Homo sapiens; identical to SEQ ID NO: 130882
  Payload ID: 5576
  Gene Symbol: EHMT2
  Gene Name: euchromatic histone-lysine N-methyltransferase 2
  ENST ID: ENST00000428442
  CDS Start-End: 21-3722

SEQ ID NO: 130901 - DNA, 4047 bp, Homo sapiens; identical to SEQ ID NO: 130890
  Payload ID: 5576
  Gene Symbol: EHMT2
  Gene Name: euchromatic histone-lysine N-methyltransferase 2
  ENST ID: ENST00000450323
  CDS Start-End: 21-3722

SEQ ID NO: 130902 - DNA, 3856 bp, Homo sapiens; identical to SEQ ID NO: 130898
  Payload ID: 5576
  Gene Symbol: EHMT2
  Gene Name: euchromatic histone-lysine N-methyltransferase 2
  ENST ID: ENST00000440987
  CDS Start-End: 1-3531

SEQ ID NO: 130903 - DNA, 894 bp, Homo sapiens; identical to SEQ ID NO: 130892
  Payload ID: 5576
  Gene Symbol: EHMT2
  Gene Name: euchromatic histone-lysine N-methyltransferase 2
  ENST ID: ENST00000451745
  CDS Start-End: 1-894

SEQ ID NO: 130904 - DNA, 894 bp, Homo sapiens; identical to SEQ ID NO: 130892
  Payload ID: 5576
  Gene Symbol: EHMT2
  Gene Name: euchromatic histone-lysine N-methyltransferase 2
  ENST ID: ENST00000424396
  CDS Start-End: 1-894

SEQ ID NO: 130905 - DNA, 4047 bp, Homo sapiens; identical to SEQ ID NO: 130882
  Payload ID: 5576
  Gene Symbol: EHMT2
  Gene Name: euchromatic histone-lysine N-methyltransferase 2
  ENST ID: ENST00000443951
  CDS Start-End: 21-3722

SEQ ID NO: 130906 - DNA, 3965 bp, Homo sapiens; identical to SEQ ID NO: 130884
  Payload ID: 5576
  Gene Symbol: EHMT2
  Gene Name: euchromatic histone-lysine N-methyltransferase 2
  Uniprot ID: Q96KQ7
  ENST ID: ENST00000429506
  CDS Start-End: 8-3640

SEQ ID NO: 130907 - DNA, 894 bp, Homo sapiens; identical to SEQ ID NO: 130892
  Payload ID: 5576
  Gene Symbol: EHMT2
  Gene Name: euchromatic histone-lysine N-methyltransferase 2
  ENST ID: ENST00000448415
  CDS Start-End: 1-894

SEQ ID NO: 130908 - DNA, 4129 bp, Homo sapiens
  Payload ID: 5576
  Gene Symbol: EHMT2
  Gene Name: euchromatic histone-lysine N-methyltransferase 2
  ENST ID: ENST00000415323
  CDS Start-End: 1-3804
atgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130909 - DNA, 3856 bp, Homo sapiens; identical to SEQ ID NO: 130883
  Payload ID: 5576
  Gene Symbol: EHMT2
  Gene Name: euchromatic histone-lysine N-methyltransferase 2
  Uniprot ID: Q96KQ7
  ENST ID: ENST00000420874
  CDS Start-End: 1-3531

SEQ ID NO: 130910 - DNA, 894 bp, Homo sapiens; identical to SEQ ID NO: 130892
  Payload ID: 5576
  Gene Symbol: EHMT2
  Gene Name: euchromatic histone-lysine N-methyltransferase 2
  ENST ID: ENST00000436026
  CDS Start-End: 1-894

SEQ ID NO: 130911 - DNA, 2992 bp, Homo sapiens
  Payload ID: 5576
  Gene Symbol: EHMT2
  Gene Name: euchromatic histone-lysine N-methyltransferase 2
  ENST ID: ENST00000458593
  CDS Start-End: 1-2667
tctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 130912 - DNA, 4129 bp, Homo sapiens; identical to SEQ ID NO: 130908
  Payload ID: 5576
  Gene Symbol: EHMT2
  Gene Name: euchromatic histone-lysine N-methyltransferase 2
  ENST ID: ENST00000446303
  CDS Start-End: 1-3804

SEQ ID NO: 130913 - DNA, 894 bp, Homo sapiens; identical to SEQ ID NO: 130892
  Payload ID: 5576
  Gene Symbol: EHMT2
  Gene Name: euchromatic histone-lysine N-methyltransferase 2
  ENST ID: ENST00000420623
  CDS Start-End: 1-894

SEQ ID NO: 130914 - DNA, 3965 bp, Homo sapiens; identical to SEQ ID NO: 130894
  Payload ID: 5576
  Gene Symbol: EHMT2
  Gene Name: euchromatic histone-lysine N-methyltransferase 2
  Uniprot ID: Q96KQ7
  ENST ID: ENST00000421926
  CDS Start-End: 8-3640

SEQ ID NO: 130915 - DNA, 3094 bp, Homo sapiens; identical to SEQ ID NO: 130897
  Payload ID: 5576
  Gene Symbol: EHMT2
  Gene Name: euchromatic histone-lysine N-methyltransferase 2
  ENST ID: ENST00000627114
  CDS Start-End: 1-2769

SEQ ID NO: 130916 - DNA, 2992 bp, Homo sapiens; identical to SEQ ID NO: 130911
  Payload ID: 5576
  Gene Symbol: EHMT2
  Gene Name: euchromatic histone-lysine N-methyltransferase 2
  ENST ID: ENST00000629838
  CDS Start-End: 1-2667

SEQ ID NO: 130917 - DNA, 7388 bp, Homo sapiens
  Payload ID: 5577
  Gene Symbol: EEF2K
  Gene Name: eukaryotic elongation factor 2 kinase
  Uniprot ID: O00418
  ENST ID: ENST00000263026
  CDS Start-End: 475-2652
aacctagaccagccccagcttcagcctcagctcccctccttcctggatcgagcgcccgcactcccggccctgcagccacccgagtcccgctcgctgtcgcctgcacgcgagtcccccctggcacgcgctcccacatcccgggatcgtcccaacggcccctgcgcccttcctgggatcactccgactgccccgcgcgccctgggatcggtccatctaccccgcgtggccccagctgcttgcccggagcgccagctagcgctccccgctctccgctccccggcactctcggggggcccgcccgccctgcaccctggagctccgggccgcgagcctctgccaactcctctggaccctcgcggccgtgggcagcggctgccgcgcctgtctgcccgagggaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccaagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttttgtcacgagatataagaaagtgctttttgccttgaatggacaattttagggctgtgctcactagtcttttcaggctggactgaaatgtcgggcccatggagccctgtgttttgtgcatcgggatgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaattttgtgttccccagggcaccaaaacacagtgctttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccaccttcaaaacctagtttgggctgggtgcagtggctcacgccactttgggaggctgaggtgggcggatcacctgaagtcagctactcgggaggctgaggcaggagaatcgcttgaacccaggaggcagaggttgcagtgagccgagattgcgtcactgcactccagcctgggcgacagagtgagactccgtctcgaaaccaaaaacaagaaaaacccctagttttgtgccttctgaagatagttaggacatcttctttttccgcaaatgctggacatgccaaaaacctaacgcaaaacccaggacattccagcccaactgggacgatatcagagaccatcttcaagtgcaagaagcaggtgaaagcccaggaaattggcagagccaggattatcatccagtactttcatttcacaaatggagaaaccgaggttctgccagctagattttttttcacagtgtcactgctagcaagccactaagctggagctgggatttgagagctgctgctatttagaggatcttgggaataaaatttaaactggagtttaatggccctttcagttttgctataggcaagagaataaaatgaatgaatggataggtggctttatgggtgtaagaaagaagcgaaaaaaactcccaaaccccagtgttcctgaatatctgttctccccctgaccactctgggaatttatcaaatgcagctttgacctccaagccaagtaaactgctcttgttgctattttagtggtttttgtttttttaagacacaaggtctcactttgttactcaggctggagtgcagtggcatgatcataactcattgtaggctcaacctcctgggccccagtgatcctcctgcctcagcctctcaagtagctaaaactacagatgtgcaccatcacatctggctaatttttttttttttttttttgaggtggagtctcgctctgttgcccagattcaagtgcaatggcacgttttggctcactgcaacctctgcctcccaggttcaagcgattctccctgtctcggcctcccgagtagctgggactacaggcacctgccaccacgcgcagctaatgtttgtatttttagtagagacgggggtttcaccatgttggccaggctggtttcaaactcctgacattaggtgatccacctgcctcggcctcccaaagtgctgggattacaggcatgagccaccgtgccaagccacgcctggctaattttttaaaattattttttgcagagacagagtttcactatgttgcccaggctggtcttgaactccttggcctcaagtgatcctcccacctcagcctcccaaagcattggggttacaggcgtgagccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttct

SEQ ID NO: 130918 - DNA, 2367 bp, Homo sapiens
  Payload ID: 5577
  Gene Symbol: EEF2K
  Gene Name: eukaryotic elongation factor 2 kinase
  ENST ID: ENST00000568269
  CDS Start-End: 431-1669
ggatcgagcgcccgcactcccggccctgcagccacccgagtcccgctcgctgtcgcctgcacgcgagtcccccctggcacgcgctcccacatcccgggatcgtcccaacggcccctgcgcccttcctgggatcactccgactgccccgcgcgccctgggatcggtccatctaccccgcgtggccccagctgcttgcccggagcgccagctagcgctccccgctctccgctccccggcactctcggggggcccgcccgccctgcaccctggagctccgggccgcgagcctctgccaactcctctggaccctcgcggccgtgggcagcggctgccgcgcctgtctgcccgagggaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccaagtaaggaccctctctgggagccggccacccctgctccgtcccctttcagagaactctggagacgagaacatgagcgacgtgaccttcgactctctcccttcttccccatcttcggccacaccacacagccagaagctagaccacctccgtgagtgacggttcggtccctagtcactgtgattggaggggacaggtggagcagagctaaaccagctttcatttatgttagaaaaatcagacatgctaatcgaaaaggttcatggccccagtggttttatagattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtaatgcgccctgaggcacccttgtctctgcctcttccctgtctcctccaggctctgttgctgtttctcctgtctcatatctctgctgcctgcccatctgtcttgcacatgtgctaaaggaagattttgcaaagcagcaaatctgggcaaatgctctttgaacctctgcagggcaggatgctgggggatttgtggggaggattagagaagagcagctcagccccatcctggaggggaaatcaccacagggacagctcctgtcttaagtgcctgccatgaaggcacttcgcagtaatcagtttccttcttgcaaccacccagagagacaggctaatgtgactctcatccccattttatgtatgaga

SEQ ID NO: 130919 - DNA, 2268 bp, Homo sapiens
  Payload ID: 5578
  Gene Symbol: EEF2KMT
  Gene Name: eukaryotic elongation factor 2 lysine methyltransferase
  Uniprot ID: Q96G04
  ENST ID: ENST00000458008
  CDS Start-End: 50-940
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacgcagtctcacccatctgtgggtaacaagggggtgtcggtgttctttgcagccttgctaaactgtctgaatcaaggatcacaaactacagcctgcaggccaaatccagcccacagcctgtgtttgtaaataaagttttattggaacaaa

SEQ ID NO: 130920 - DNA, 2390 bp, Homo sapiens
  Payload ID: 5578
  Gene Symbol: EEF2KMT
  Gene Name: eukaryotic elongation factor 2 lysine methyltransferase
  Uniprot ID: Q96G04
  ENST ID: ENST00000427587
  CDS Start-End: 70-1062
ccgccccctcttcagtccaggccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacgcagtctcacccatctgtgggtaacaagggggtgtcggtgttctttgcagccttgctaaactgtctgaatcaaggatcacaaactacagcctgcaggccaaatccagcccacagcctgtgtttgtaaataaagttttattggaacaaa

SEQ ID NO: 130921 - DNA, 1282 bp, Homo sapiens
  Payload ID: 5578
  Gene Symbol: EEF2KMT
  Gene Name: eukaryotic elongation factor 2 lysine methyltransferase
  ENST ID: ENST00000587161
  CDS Start-End: 28-204
cggcaacgctgcggccccgcccacgtcatggcgcccgaggagaacgcggggaccgaactcttgctgcagagtttcgagcgccgcttcctggcggcacgcacactgcgctccttcccctggcaggcagtaatcgttctggtcactgggacacagctgccctcgcccattctaaaaagtcagcgccgtcaggaccgcagagcttagaagcaaagttaagagactcatcagattctgagctgctgcgggatattttgcacaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgc

SEQ ID NO: 130922 - DNA, 1652 bp, Homo sapiens
  Payload ID: 5578
  Gene Symbol: EEF2KMT
  Gene Name: eukaryotic elongation factor 2 lysine methyltransferase
  ENST ID: ENST00000585436
  CDS Start-End: 16-237
ggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaaggtaagaatcccagagtccctgggactcatgaccctgcctcctgaatctctccagaagacctgagagaagaactgcagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctca

SEQ ID NO: 130923 - DNA, 684 bp, Homo sapiens
  Payload ID: 5578
  Gene Symbol: EEF2KMT
  Gene Name: eukaryotic elongation factor 2 lysine methyltransferase
  ENST ID: ENST00000587200
  CDS Start-End: 36-257
cggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaaggtaagaatcccagagtccctgggactcatgaccctgcctcctgaatctctccagaagacctgagagaagaactgcagattagaacgaaagcaaacaagctctcactctgtctgcccccagcacgaggctgtccacacagagcctttggacgagctgtatgaagcgctggcggagaccctgatggccaaggagtccacccagggccaccggagctatttgctgatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactcc

SEQ ID NO: 130924 - DNA, 873 bp, Homo sapiens
  Payload ID: 5578
  Gene Symbol: EEF2KMT
  Gene Name: eukaryotic elongation factor 2 lysine methyltransferase
  ENST ID: ENST00000587133
  CDS Start-End: 4-813
gtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttt

SEQ ID NO: 130925 - DNA, 2232 bp, Homo sapiens
  Payload ID: 5579
  Gene Symbol: EEFSEC
  Gene Name: eukaryotic elongation factor, selenocysteine-tRNA-specific
  Uniprot ID: P57772
  ENST ID: ENST00000254730
  CDS Start-End: 55-1845
taccgagggaggtgaggggcgggccgggcgggtgtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagatccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagcccactcta

SEQ ID NO: 130926 - DNA, 1859 bp, Homo sapiens
  Payload ID: 5579
  Gene Symbol: EEFSEC
  Gene Name: eukaryotic elongation factor, selenocysteine-tRNA-specific
  ENST ID: ENST00000483457
  CDS Start-End: 8-1318
cggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagcccac

SEQ ID NO: 130927 - DNA, 1923 bp, Homo sapiens
  Payload ID: 5580
  Gene Symbol: EEF1A1
  Gene Name: eukaryotic translation elongation factor 1 alpha 1
  Uniprot ID: P68104
  ENST ID: ENST00000331523
  CDS Start-End: 246-1634
cgttaaggaggcccccagtcccgacccttcgccccaagcccctcggggtccccgggcctggtactccttgccacacgggaggggcgcggaagccggggcggaggaggagccaaccccgggctgggctgagacccgcagaggaagacgctctagggatttgtcccggactagcgagatggcaaggctgaggacgggaggctgattgagaggcgaaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaat

SEQ ID NO: 130928 - DNA, 2303 bp, Homo sapiens
  Payload ID: 5580
  Gene Symbol: EEF1A1
  Gene Name: eukaryotic translation elongation factor 1 alpha 1
  Uniprot ID: P68104
  ENST ID: ENST00000309268
  CDS Start-End: 620-2008
cgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 130929 - DNA, 4441 bp, Homo sapiens
  Payload ID: 5580
  Gene Symbol: EEF1A1
  Gene Name: eukaryotic translation elongation factor 1 alpha 1
  Uniprot ID: P68104
  ENST ID: ENST00000316292
  CDS Start-End: 993-2381
gtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagctttaa

SEQ ID NO: 130930 - DNA, 635 bp, Homo sapiens
  Payload ID: 5580
  Gene Symbol: EEF1A1
  Gene Name: eukaryotic translation elongation factor 1 alpha 1
  ENST ID: ENST00000356303
  CDS Start-End: 200-635
gtaggactgagtctattctaaactgaaagcctggacatctggagtaccagggggagatgacgtgttacgggcttccataaaagcagctggctttgaatggaaggagccaagaggccagcacaggagcggattcgtcgctttcacggccatcgagccgaacctctcgcaagtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtga

SEQ ID NO: 130931 - DNA, 701 bp, Homo sapiens
  Payload ID: 5580
  Gene Symbol: EEF1A1
  Gene Name: eukaryotic translation elongation factor 1 alpha 1
  ENST ID: ENST00000455918
  CDS Start-End: 382-701
ctgacgctgcggaggctcgagcggcgtatccataccacccagctgttcgccgcgggaacccgccggcccgcaggtgacccagcgctggaaaaacgccagcgacgtggcctggcgagctggcgcggggcaaggaccacccgcgcccgccttgccgccccagcctccctccctaggaagcagggtgcgccccggtgcgcgcggggcttccccggaccggcgttccagtccctctccggcttccggcccaccccggccccactgagagcagaaatgtgatctctgccctgagaaaatgctcgtggccagtgactacccctaacgcacaataatatggctccgatgggctcaaaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatc

SEQ ID NO: 130932 - DNA, 3508 bp, Homo sapiens
  Payload ID: 5580
  Gene Symbol: EEF1A1
  Gene Name: eukaryotic translation elongation factor 1 alpha 1
  ENST ID: ENST00000615060
  CDS Start-End: 64-1344
ctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttccgagtggagactggtgttctcccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaagtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagcttt

SEQ ID NO: 130933 - DNA, 3447 bp, Homo sapiens
  Payload ID: 5580
  Gene Symbol: EEF1A1
  Gene Name: eukaryotic translation elongation factor 1 alpha 1
  ENST ID: ENST00000610520
  CDS Start-End: 64-1389
ctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagcttt

SEQ ID NO: 130934 - DNA, 2006 bp, Homo sapiens
  Payload ID: 5581
  Gene Symbol: EEF1A2
  Gene Name: eukaryotic translation elongation factor 1 alpha 2
  Uniprot ID: Q05639
  ENST ID: ENST00000217182
  CDS Start-End: 330-1721
gccccgcccccgcccgcggcgcgtttctcccccgcctcccgcgtccgtctttgcagcccgcgcctcccgcatcgcctcgcgtccccgtggcgcccgcccgcgcgcgtccgcgccccgccccctcccgcgcggttccgcattggcgtgctgcagggcgcggtgcactgcgccgccaccgtcaataggtggaccccctcccggagataaaaccgccggcgccggcgccgccagtccctctggctgagacctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 130935 - DNA, 1748 bp, Homo sapiens
  Payload ID: 5581
  Gene Symbol: EEF1A2
  Gene Name: eukaryotic translation elongation factor 1 alpha 2
  Uniprot ID: Q05639
  ENST ID: ENST00000298049
  CDS Start-End: 72-1463
aatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 130936 - DNA, 844 bp, Homo sapiens
  Payload ID: 5582
  Gene Symbol: EEF1B2
  Gene Name: eukaryotic translation elongation factor 1 beta 2
  Uniprot ID: P24534
  ENST ID: ENST00000236957
  CDS Start-End: 122-799
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 130937 - DNA, 880 bp, Homo sapiens
  Payload ID: 5582
  Gene Symbol: EEF1B2
  Gene Name: eukaryotic translation elongation factor 1 beta 2
  Uniprot ID: P24534
  ENST ID: ENST00000392221
  CDS Start-End: 159-836
gccggaagtggccccagcctcgaggccgggcgtcttcggtcatctccggcgcttctagggctggttcccgtcatcttcgggagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatt

SEQ ID NO: 130938 - DNA, 1098 bp, Homo sapiens
  Payload ID: 5582
  Gene Symbol: EEF1B2
  Gene Name: eukaryotic translation elongation factor 1 beta 2
  Uniprot ID: P24534
  ENST ID: ENST00000392222
  CDS Start-End: 376-1053
ccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 130939 - DNA, 670 bp, Homo sapiens
  Payload ID: 5582
  Gene Symbol: EEF1B2
  Gene Name: eukaryotic translation elongation factor 1 beta 2
  ENST ID: ENST00000455150
  CDS Start-End: 47-253
gcgctctctttctgctgctccccagctctcggatacagccgacaccatgggtttcggagacctgaaaagccctgccggcctccaggtgtgtgtgaatgtttctgtgtccttggcaggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgagg

SEQ ID NO: 130940 - DNA, 649 bp, Homo sapiens
  Payload ID: 5582
  Gene Symbol: EEF1B2
  Gene Name: eukaryotic translation elongation factor 1 beta 2
  ENST ID: ENST00000415904
  CDS Start-End: 54-260
aatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatatggttgaatttaaatgtttttcaagcctgccaggagtgaagaaagctttgggcaaatatggtcctgccgatgtggaagacactacaggaagtggagctacagatagtaaagatgatgatgacattgacctctttggatctgatgatg

SEQ ID NO: 130941 - DNA, 912 bp, Homo sapiens
  Payload ID: 5582
  Gene Symbol: EEF1B2
  Gene Name: eukaryotic translation elongation factor 1 beta 2
  ENST ID: ENST00000429769
  CDS Start-End: 71-277
tctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatacctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttgg

SEQ ID NO: 130942 - DNA, 389 bp, Homo sapiens
  Payload ID: 5582
  Gene Symbol: EEF1B2
  Gene Name: eukaryotic translation elongation factor 1 beta 2
  ENST ID: ENST00000435123
  CDS Start-End: 47-136
gcgctctctttctgctgctccccagctctcggatacagccgacaccatgggtttcggagacctgaaaagccctgccggcctccaggtgctcaacgattacctggcggacaagagctacatcgaggggtgtgtgtgaatgtttctgtgtccttggcaggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctcttt

SEQ ID NO: 130943 - DNA, 515 bp, Homo sapiens
  Payload ID: 5582
  Gene Symbol: EEF1B2
  Gene Name: eukaryotic translation elongation factor 1 beta 2
  ENST ID: ENST00000445505
  CDS Start-End: 146-515
ccagcctcgaggccgggcgtcttcggtcatctccggcgcttctagggctggttcccgtcatcttcgggagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttg

SEQ ID NO: 130944 - DNA, 1458 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000317198
  CDS Start-End: 518-1363
gccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctc

SEQ ID NO: 130945 - DNA, 1249 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000395119
  CDS Start-End: 340-1185
cggcgacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130946 - DNA, 1452 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000419152
  CDS Start-End: 512-1357
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctc

SEQ ID NO: 130947 - DNA, 2207 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000442189
  CDS Start-End: 200-2143
ctccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130948 - DNA, 2378 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000423316
  CDS Start-End: 340-2283
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctc

SEQ ID NO: 130949 - DNA, 559 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000525261
  CDS Start-End: 316-559
ctccctttcatcagtcttcccgcgtccgccgattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcagga

SEQ ID NO: 130950 - DNA, 343 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000524900
  CDS Start-End: 156-343
ctttcatcagtcttcccgcgtccgccgattcctcctccttggtcgccgcgtccttggctggcgtagacagggtttcaacgtgttagccaggatggtctcagtctccagaccctgtgatccgcccgcctcggcctcccaaagtgttgggattacagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggc

SEQ ID NO: 130951 - DNA, 616 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000530545
  CDS Start-End: 365-616
ctccctttcatcagtcttcccgcgtccgccgattcctcctccttggtcgccgcgtccttggctggcgtggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctg

SEQ ID NO: 130952 - DNA, 617 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000534377
  CDS Start-End: 57-617
ttcccgcgtccgccgattcctcctccttggtcgccgcgtccttggctggcgtaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatg

SEQ ID NO: 130953 - DNA, 610 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000525223
  CDS Start-End: 494-610
ccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagaaaaatggctacaaacttcctagcacatgagaagatctggttcgacaagttcaaatatgacgacgcagaaaggagattctacgagcagatgaacgggcctgtggcaggtgcctcccgccag

SEQ ID NO: 130954 - DNA, 473 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000529516
  CDS Start-End: 55-473
cccgcgtccgccgattcctcctccttggtcgccgcgtccttggctggcgtaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacct

SEQ ID NO: 130955 - DNA, 923 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000528610
  CDS Start-End: 86-859
ccgggcggccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130956 - DNA, 749 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000530616
  CDS Start-End: 1-632
agcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgt

SEQ ID NO: 130957 - DNA, 633 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000533749
  CDS Start-End: 221-633
cctgcagccctcgggcggacccccatcatcgtccaggtgcagccactccgcaacctcctccggagccaggcacttgtaggccagagccgccaggtgggtgaggtcgctgagcaccctgctgtgctcggcggcttcctcggcctgggccggctgcccagcactgtcctcgccgggccggggctcgaaggcagcccgcaggcccagcagccagcagcgctcaatgctgcccgcctgcaccaggtcccaggagaggccagccagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggcca

SEQ ID NO: 130958 - DNA, 813 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000531281
  CDS Start-End: 43-813
ttgctcccgggttgctgggtgaggctgcaaggtttagcacagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccaggg

SEQ ID NO: 130959 - DNA, 840 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000531621
  CDS Start-End: 61-777
cttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccgg

SEQ ID NO: 130960 - DNA, 831 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000533833
  CDS Start-End: 89-409
ggcccgggcggccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130961 - DNA, 761 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000532596
  CDS Start-End: 191-761
ctccctttcatcagtcttcccgcgtccgccgattcctcctccttggtcgccgcgtccttggctggcgtggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggca

SEQ ID NO: 130962 - DNA, 828 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000524883
  CDS Start-End: 287-828
gctctgttgtccaggctggagtgcagtggcgccatctcggttcactgcaagctccgcctcccggcttcacgccattctcctgcctcagcctccctaggagctgggactacaggcgcctgccaccacgcccggctaatttttatttttatttttagtagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtc

SEQ ID NO: 130963 - DNA, 555 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000534804
  CDS Start-End: 351-555
ctccctttcatcagtcttcccgcgtccgccgattcctcctccttggtcgccgcgtccttggctggcgttgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaatagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcg

SEQ ID NO: 130964 - DNA, 558 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000528303
  CDS Start-End: 495-558
ctccctttcatcagtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaatgaggagcgggaaggcctcctgcaccctggagaccgtgtgggaagacaagcacaagtatgagg

SEQ ID NO: 130965 - DNA, 538 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000534475
  CDS Start-End: 445-538
ccctttcatcagtcttcccgcgtccgccgattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaatagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgagg

SEQ ID NO: 130966 - DNA, 758 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000533494
  CDS Start-End: 254-758
cgcgtccttggctggcgtggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggaca

SEQ ID NO: 130967 - DNA, 583 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000530306
  CDS Start-End: 197-583
ctccctttcatcagtcttcccgcgtccgccgattcctcctccttggtcgccgcgtccttggctggcgtagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctg

SEQ ID NO: 130968 - DNA, 1001 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000534380
  CDS Start-End: 217-1001
gtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggtgcgctgcgtccggcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggagga

SEQ ID NO: 130969 - DNA, 926 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000531670
  CDS Start-End: 390-926
caccttcgccttctcaccacatgcctcaggcccagccaggctcctagacctgcctctgtagaggctttctgggcgcagtgccaatcctgtgagacagcagcatctcccctgggctgctgcagggttcacacgcagtcagtgctggcagagtgagcgcccagccgacagagcccccgctgcctcccgcctcctctggaggactaggccctctgggctttgctcccgggttgctgggtgaggctgcaaggtttagcacagtagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggag

SEQ ID NO: 130970 - DNA, 419 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000532400
  CDS Start-End: 57-356
ccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctg

SEQ ID NO: 130971 - DNA, 2387 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000532741
  CDS Start-End: 230-2323
taaagcttatttcagataaatgacgaaaaatttttagtgtaagtatgtctcagatacttcatgggccatacattcactaacaaaattatatattgttcatgtattgggaggcacttggcctcccagagtactgagattacaggcatgagccactgcgcccggcctgttttctcttcacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130972 - DNA, 791 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000532543
  CDS Start-End: 675-791
cagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaaggagcccccgagcgtcctctgaggaagtagacgctcaccttcgccttctcaccacatgcctcaggcccagccaggctcctagacctgcctctgtagaggctttctgggcgcagtgccaatcctgtgagacagcagcatctcccctgggctgctgcagggttcacacgcagtcagtgctggcagagtgagcgcccagccgacagagcccccgctgcctcccgcctcctctggaggactaggccctctgggctttgctcccgggttgctgggtgaggctgcaaggtttagcacagcagaaaaatggctacaaacttcctagcacatgagaagatctggttcgacaagttcaaatatgacgacgcagaaaggagattctacgagcagatgaacgggcctgtggcaggtgcctcccgccag

SEQ ID NO: 130973 - DNA, 996 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000526710
  CDS Start-End: 96-996
catttcccgtgcgcggcccgggcggccctccctttcatcagtcttcccgcgtccgccgattcctcctccttggtcgccgcgtccttggctggcgtatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctg

SEQ ID NO: 130974 - DNA, 787 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000531218
  CDS Start-End: 192-787
ctcctccttggtcgccgcgtccttggctggcgttgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcct

SEQ ID NO: 130975 - DNA, 842 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000533204
  CDS Start-End: 231-842
gcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcct

SEQ ID NO: 130976 - DNA, 1311 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000529272
  CDS Start-End: 402-1247
cgcgcctgcgcgctggccgcctcgtgcgtcactcggcgcttgccggctgccggacccgcccccaccggcgacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130977 - DNA, 424 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000529576
  CDS Start-End: 1-360
ggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtgtcgatatcgcagctttcaacaagatctgaagcctgagtgtgtgtacgtgcgcgcgtgcgtgaggccctgccacgattaaagactgagaccggc

SEQ ID NO: 130978 - DNA, 533 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000530109
  CDS Start-End: 1-469
tcccctgtggcagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130979 - DNA, 770 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000526340
  CDS Start-End: 582-770
cgtccgccgattcctcctccttggtcgccgcgtccttggctggcgtatgtgtggagacctccaggccgtgcagcaccttggtggccacagctctccaggatgtcctcaccttcctcagggccctgccctcctgacctggagtgttctggaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggtgcgctgcgtccggcagggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctgga

SEQ ID NO: 130980 - DNA, 367 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000526133
  CDS Start-End: 258-367
gggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctatgaggagcgggaaggcctcctgcaccctggagaccgtgtgggaagacaagcacaagtatgaggaggccgagcggcgcttctacgaacacgaggccacacaggcggccgc

SEQ ID NO: 130981 - DNA, 1084 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000524624
  CDS Start-End: 255-1028
ctccctttcatcagtcttcccgcgtccgccgattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactg

SEQ ID NO: 130982 - DNA, 506 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000531953
  CDS Start-End: 359-506
actgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctatagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatga

SEQ ID NO: 130983 - DNA, 861 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000529007
  CDS Start-End: 48-440
ccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccgg

SEQ ID NO: 130984 - DNA, 553 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000528519
  CDS Start-End: 82-553
acaatgccctgtctcctgggctcttgctcccaccccacccccaacccacaacccctgcctctgcccatcagcctggccttgatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccacc

SEQ ID NO: 130985 - DNA, 926 bp, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000526838
  CDS Start-End: 74-862
ccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 130986 - DNA, 853 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000530191
  CDS Start-End: 242-853
gtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcct

SEQ ID NO: 130987 - DNA, 535 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000526135
  CDS Start-End: 376-535
gggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggcc

SEQ ID NO: 130988 - DNA, 308 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000528382
  CDS Start-End: 199-308
agatctggttcgacaagttcaaatatgacgacgcagaaaggagattctacgagcagatgaacgggcctgtggcaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtg

SEQ ID NO: 130989 - DNA, 1217 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000530445
  CDS Start-End: 720-1217
ctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtgagccgagatcgcgccgctgattccagcctgggcgacaagagtgagactccatctcacacaaaaaaaaaataacaaaaaaactcagaaatgctaagtgtacttatttgttgaagaaacttgttacatattactaacatcttttttttttatgagaaatacttttcccataaccaaaaaattcagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggcttggtgtcgctttgtggagaaccgctggtgtctgaagcgggtgtcagccccactgcaccttggtgcttctgggctgtcctgatgccgaggcccacttcccagccatgctgactttgcctctttcccctcccagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggag

SEQ ID NO: 130990 - DNA, 614 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000531931
  CDS Start-End: 509-614
ccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggatagcagaaaaatggctacaaacttcctagcacatgagaagatctggttcgacaagttcaaatatgacgacgcagaaaggagattctacgagcagatgaacgggcctgtggcaggtg

SEQ ID NO: 130991 - DNA, 600 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000529832
  CDS Start-End: 163-600
ctccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggt

SEQ ID NO: 130992 - DNA, 957 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000524397
  CDS Start-End: 244-636
cagtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgt

SEQ ID NO: 130993 - DNA, 2207 bp, Homo sapiens; identical to SEQ ID NO: 130947
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000619144
  CDS Start-End: 200-2143

SEQ ID NO: 130994 - DNA, 2238 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000619198
  CDS Start-End: 343-2238
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtgggaggacgacaaggtggggacagacttgctggaggaggagatcaccaagtttga

SEQ ID NO: 130995 - DNA, 1249 bp, Homo sapiens; identical to SEQ ID NO: 130945
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000614575
  CDS Start-End: 340-1185

SEQ ID NO: 130996 - DNA, 1452 bp, Homo sapiens; identical to SEQ ID NO: 130946
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000615067
  CDS Start-End: 512-1357

SEQ ID NO: 130997 - DNA, 2378 bp, Homo sapiens; identical to SEQ ID NO: 130948
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000620155
  CDS Start-End: 340-2283

SEQ ID NO: 130998 - DNA, 1458 bp, Homo sapiens; identical to SEQ ID NO: 130944
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000615698
  CDS Start-End: 518-1363

SEQ ID NO: 130999 - DNA, 2238 bp, Homo sapiens; identical to SEQ ID NO: 130994
  Payload ID: 5583
  Gene Symbol: EEF1D
  Gene Name: eukaryotic translation elongation factor 1 delta (guanine nucleotide exchange protein)
  ENST ID: ENST00000618139
  CDS Start-End: 343-2238

SEQ ID NO: 131000 - DNA, 926 bp, Homo sapiens; identical to SEQ ID NO: 130969
  Payload ID: 5583
  Gene Symbol: EEF1D
  Gene Name: eukaryotic translation elongation factor 1 delta (guanine nucleotide exchange protein)
  ENST ID: ENST00000633090
  CDS Start-End: 390-926

SEQ ID NO: 131001 - DNA, 558 bp, Homo sapiens; identical to SEQ ID NO: 130964
  Payload ID: 5583
  Gene Symbol: EEF1D
  Gene Name: eukaryotic translation elongation factor 1 delta (guanine nucleotide exchange protein)
  ENST ID: ENST00000633857
  CDS Start-End: 495-558

SEQ ID NO: 131002 - DNA, 616 bp, Homo sapiens; identical to SEQ ID NO: 130951
  Payload ID: 5583
  Gene Symbol: EEF1D
  Gene Name: eukaryotic translation elongation factor 1 delta (guanine nucleotide exchange protein)
  ENST ID: ENST00000633887
  CDS Start-End: 365-616

SEQ ID NO: 131003 - DNA, 1311 bp, Homo sapiens; identical to SEQ ID NO: 130976
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000632587
  CDS Start-End: 402-1247

SEQ ID NO: 131004 - DNA, 787 bp, Homo sapiens; identical to SEQ ID NO: 130974
  Payload ID: 5583
  Gene Symbol: EEF1D
  Gene Name: eukaryotic translation elongation factor 1 delta (guanine nucleotide exchange protein)
  ENST ID: ENST00000632115
  CDS Start-End: 192-787

SEQ ID NO: 131005 - DNA, 1217 bp, Homo sapiens; identical to SEQ ID NO: 130989
  Payload ID: 5583
  Gene Symbol: EEF1D
  Gene Name: eukaryotic translation elongation factor 1 delta (guanine nucleotide exchange protein)
  ENST ID: ENST00000634156
  CDS Start-End: 720-1217

SEQ ID NO: 131006 - DNA, 1001 bp, Homo sapiens; identical to SEQ ID NO: 130968
  Payload ID: 5583
  Gene Symbol: EEF1D
  Gene Name: eukaryotic translation elongation factor 1 delta (guanine nucleotide exchange protein)
  ENST ID: ENST00000632423
  CDS Start-End: 217-1001

SEQ ID NO: 131007 - DNA, 614 bp, Homo sapiens; identical to SEQ ID NO: 130990
  Payload ID: 5583
  Gene Symbol: EEF1D
  Gene Name: eukaryotic translation elongation factor 1 delta (guanine nucleotide exchange protein)
  ENST ID: ENST00000631585
  CDS Start-End: 509-614

SEQ ID NO: 131008 - DNA, 573 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000631763
  CDS Start-End: 414-573
gattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggcc

SEQ ID NO: 131009 - DNA, 555 bp, Homo sapiens; identical to SEQ ID NO: 130963
  Payload ID: 5583
  Gene Symbol: EEF1D
  Gene Name: eukaryotic translation elongation factor 1 delta (guanine nucleotide exchange protein)
  ENST ID: ENST00000631688
  CDS Start-End: 351-555

SEQ ID NO: 131010 - DNA, 343 bp, Homo sapiens; identical to SEQ ID NO: 130950
  Payload ID: 5583
  Gene Symbol: EEF1D
  Gene Name: eukaryotic translation elongation factor 1 delta (guanine nucleotide exchange protein)
  ENST ID: ENST00000632733
  CDS Start-End: 156-343

SEQ ID NO: 131011 - DNA, 840 bp, Homo sapiens; identical to SEQ ID NO: 130959
  Payload ID: 5583
  Gene Symbol: EEF1D
  Gene Name: eukaryotic translation elongation factor 1 delta (guanine nucleotide exchange protein)
  ENST ID: ENST00000631650
  CDS Start-End: 61-777

SEQ ID NO: 131012 - DNA, 923 bp, Homo sapiens; identical to SEQ ID NO: 130955
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000632675
  CDS Start-End: 86-859

SEQ ID NO: 131013 - DNA, 553 bp, Homo sapiens; identical to SEQ ID NO: 130984
  Payload ID: 5583
  Gene Symbol: EEF1D
  Gene Name: eukaryotic translation elongation factor 1 delta (guanine nucleotide exchange protein)
  ENST ID: ENST00000633928
  CDS Start-End: 82-553

SEQ ID NO: 131014 - DNA, 367 bp, Homo sapiens; identical to SEQ ID NO: 130980
  Payload ID: 5583
  Gene Symbol: EEF1D
  Gene Name: eukaryotic translation elongation factor 1 delta (guanine nucleotide exchange protein)
  ENST ID: ENST00000631875
  CDS Start-End: 258-367

SEQ ID NO: 131015 - DNA, 770 bp, Homo sapiens
  Payload ID: 5583
  Gene Symbol: EEF1D
  Gene Name: eukaryotic translation elongation factor 1 delta (guanine nucleotide exchange protein)
  ENST ID: ENST00000633686
  CDS Start-End: 266-770
ctccttggtcgccgcgtccttggctggcgtggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggaca

SEQ ID NO: 131016 - DNA, 559 bp, Homo sapiens; identical to SEQ ID NO: 130949
  Payload ID: 5583
  Gene Symbol: EEF1D
  Gene Name: eukaryotic translation elongation factor 1 delta (guanine nucleotide exchange protein)
  ENST ID: ENST00000632626
  CDS Start-End: 316-559

SEQ ID NO: 131017 - DNA, 853 bp, Homo sapiens; identical to SEQ ID NO: 130986
  Payload ID: 5583
  Gene Symbol: EEF1D
  Gene Name: eukaryotic translation elongation factor 1 delta (guanine nucleotide exchange protein)
  ENST ID: ENST00000632402
  CDS Start-End: 242-853

SEQ ID NO: 131018 - DNA, 828 bp, Homo sapiens; identical to SEQ ID NO: 130962
  Payload ID: 5583
  Gene Symbol: EEF1D
  Gene Name: eukaryotic translation elongation factor 1 delta (guanine nucleotide exchange protein)
  ENST ID: ENST00000633394
  CDS Start-End: 287-828

SEQ ID NO: 131019 - DNA, 600 bp, Homo sapiens; identical to SEQ ID NO: 130991
  Payload ID: 5583
  Gene Symbol: EEF1D
  Gene Name: eukaryotic translation elongation factor 1 delta (guanine nucleotide exchange protein)
  ENST ID: ENST00000632241
  CDS Start-End: 163-600

SEQ ID NO: 131020 - DNA, 1084 bp, Homo sapiens; identical to SEQ ID NO: 130981
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000632965
  CDS Start-End: 255-1028

SEQ ID NO: 131021 - DNA, 770 bp, Homo sapiens; identical to SEQ ID NO: 130979
  Payload ID: 5583
  Gene Symbol: EEF1D
  Gene Name: eukaryotic translation elongation factor 1 delta (guanine nucleotide exchange protein)
  ENST ID: ENST00000633697
  CDS Start-End: 582-770

SEQ ID NO: 131022 - DNA, 538 bp, Homo sapiens; identical to SEQ ID NO: 130965
  Payload ID: 5583
  Gene Symbol: EEF1D
  Gene Name: eukaryotic translation elongation factor 1 delta (guanine nucleotide exchange protein)
  ENST ID: ENST00000633259
  CDS Start-End: 445-538

SEQ ID NO: 131023 - DNA, 996 bp, Homo sapiens; identical to SEQ ID NO: 130973
  Payload ID: 5583
  Gene Symbol: EEF1D
  Gene Name: eukaryotic translation elongation factor 1 delta (guanine nucleotide exchange protein)
  ENST ID: ENST00000632238
  CDS Start-End: 96-996

SEQ ID NO: 131024 - DNA, 419 bp, Homo sapiens; identical to SEQ ID NO: 130970
  Payload ID: 5583
  Gene Symbol: EEF1D
  Gene Name: eukaryotic translation elongation factor 1 delta (guanine nucleotide exchange protein)
  ENST ID: ENST00000632659
  CDS Start-End: 57-356

SEQ ID NO: 131025 - DNA, 473 bp, Homo sapiens; identical to SEQ ID NO: 130954
  Payload ID: 5583
  Gene Symbol: EEF1D
  Gene Name: eukaryotic translation elongation factor 1 delta (guanine nucleotide exchange protein)
  ENST ID: ENST00000633641
  CDS Start-End: 55-473

SEQ ID NO: 131026 - DNA, 610 bp, Homo sapiens; identical to SEQ ID NO: 130953
  Payload ID: 5583
  Gene Symbol: EEF1D
  Gene Name: eukaryotic translation elongation factor 1 delta (guanine nucleotide exchange protein)
  ENST ID: ENST00000634157
  CDS Start-End: 1-330

SEQ ID NO: 131027 - DNA, 791 bp, Homo sapiens; identical to SEQ ID NO: 130972
  Payload ID: 5583
  Gene Symbol: EEF1D
  Gene Name: eukaryotic translation elongation factor 1 delta (guanine nucleotide exchange protein)
  ENST ID: ENST00000633396
  CDS Start-End: 675-791

SEQ ID NO: 131028 - DNA, 842 bp, Homo sapiens; identical to SEQ ID NO: 130975
  Payload ID: 5583
  Gene Symbol: EEF1D
  Gene Name: eukaryotic translation elongation factor 1 delta (guanine nucleotide exchange protein)
  ENST ID: ENST00000631863
  CDS Start-End: 231-842

SEQ ID NO: 131029 - DNA, 926 bp, Homo sapiens; identical to SEQ ID NO: 130985
  Payload ID: 5583
  Gene Symbol: EEF1D
  Gene Name: eukaryotic translation elongation factor 1 delta (guanine nucleotide exchange protein)
  Uniprot ID: P29692
  ENST ID: ENST00000631698
  CDS Start-End: 74-862

SEQ ID NO: 131030 - DNA, 506 bp, Homo sapiens; identical to SEQ ID NO: 130982
  Payload ID: 5583
  Gene Symbol: EEF1D
  Gene Name: eukaryotic translation elongation factor 1 delta (guanine nucleotide exchange protein)
  ENST ID: ENST00000633476
  CDS Start-End: 359-506

SEQ ID NO: 131031 - DNA, 813 bp, Homo sapiens; identical to SEQ ID NO: 130958
  Payload ID: 5583
  Gene Symbol: EEF1D
  Gene Name: eukaryotic translation elongation factor 1 delta (guanine nucleotide exchange protein)
  ENST ID: ENST00000632162
  CDS Start-End: 43-813

SEQ ID NO: 131032 - DNA, 583 bp, Homo sapiens; identical to SEQ ID NO: 130967
  Payload ID: 5583
  Gene Symbol: EEF1D
  Gene Name: eukaryotic translation elongation factor 1 delta (guanine nucleotide exchange protein)
  ENST ID: ENST00000633058
  CDS Start-End: 197-583

SEQ ID NO: 131033 - DNA, 761 bp, Homo sapiens; identical to SEQ ID NO: 130961
  Payload ID: 5583
  Gene Symbol: EEF1D
  Gene Name: eukaryotic translation elongation factor 1 delta (guanine nucleotide exchange protein)
  ENST ID: ENST00000631850
  CDS Start-End: 191-761

SEQ ID NO: 131034 - DNA, 617 bp, Homo sapiens; identical to SEQ ID NO: 130952
  Payload ID: 5583
  Gene Symbol: EEF1D
  Gene Name: eukaryotic translation elongation factor 1 delta (guanine nucleotide exchange protein)
  ENST ID: ENST00000633339
  CDS Start-End: 57-617

SEQ ID NO: 131035 - DNA, 1077 bp, Homo sapiens
  Payload ID: 5584
  Gene Symbol: EEF1E1
  Gene Name: eukaryotic translation elongation factor 1 epsilon 1
  Uniprot ID: O43324
  ENST ID: ENST00000379715
  CDS Start-End: 58-582
aatgcgggaggttcttgttctgcaggtctcgcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaata

SEQ ID NO: 131036 - DNA, 562 bp, Homo sapiens
  Payload ID: 5584
  Gene Symbol: EEF1E1
  Gene Name: eukaryotic translation elongation factor 1 epsilon 1
  Uniprot ID: O43324
  ENST ID: ENST00000429723
  CDS Start-End: 28-447
gcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttataataaggaagctgaggcacacagaggtagggaactaacccaacatcatacaaggaactgagatcaaggaactgagattcaaacacaaatgtctggctcaaacttacctgtaaactactctacatggagtgccataaaattctgcttaattaa

SEQ ID NO: 131037 - DNA, 654 bp, Homo sapiens
  Payload ID: 5584
  Gene Symbol: EEF1E1
  Gene Name: eukaryotic translation elongation factor 1 epsilon 1
  ENST ID: ENST00000507463
  CDS Start-End: 39-491
ctgcaggtctcgcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagtgagtatttgtatagttactggctttttttctgtagtgttgagaatgatttttaaaactttgtcttgaatttaaatcagatttgcatttttggcttatcaaataaaaatgaaaggaattcctttatacaaggtgccttttgtaacaaacctgcacgttgtgcacatgtaccctaaaacttaaagtataataataataaaatttaaaaaaactttgtcttgaatttaaatca

SEQ ID NO: 131038 - DNA, 443 bp, Homo sapiens
  Payload ID: 5584
  Gene Symbol: EEF1E1
  Gene Name: eukaryotic translation elongation factor 1 epsilon 1
  ENST ID: ENST00000488226
  CDS Start-End: 160-443
gttatagctaacagggtgccaggtagcaccgtgctgggtctggggaatacaatgatgatttaggggaacatgcttcctcctctcaggcagcttgctttttggccaggtggacaaacattgcaaccatttaaattggaagagtgccacgttgcaccataaatggcagagagaacacctaaggagtcttggcccaatctaggggattcggggaaggcgtttctaaagccttggattatcagtttaagtgttacgacccacagtgaatgcgggaaacatcacaagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtaga

SEQ ID NO: 131039 - DNA, 460 bp, Homo sapiens
  Payload ID: 5584
  Gene Symbol: EEF1E1
  Gene Name: eukaryotic translation elongation factor 1 epsilon 1
  ENST ID: ENST00000515633
  CDS Start-End: 1-171
gtagatgggcactccagtaaaaatgacatccacacactgttgaaggttctcactctgtcacccaggctggaatgcaatggcgtaatcttggctcactgcaacctccgcctcctgggttcaagtgattctcgtgcctcagcctcccgagtaaatgggattacaggatcttaattcatatcttgaagataaagtctaccttacagggtataactttacattagcagatatactattgtactatggacttcatcgctttatagtgagtatttgtatagttactggctttttttctgtagtgttgagaatgatttttaaaactttgtcttgaatttaaatcagatttgcatttttggcttatcaaataaaaatgaaaggaattcctttatacaaggtgccttttgtaacaaacctgcacgttgtgcacatgtaccctaaaacttaaagtataataataataaaa

SEQ ID NO: 131040 - DNA, 591 bp, Homo sapiens
  Payload ID: 5584
  Gene Symbol: EEF1E1
  Gene Name: eukaryotic translation elongation factor 1 epsilon 1
  ENST ID: ENST00000502429
  CDS Start-End: 1-410
tgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagcaaatcatgattgttttgtttataagaaaatgaggattgtaacaggcccccatgtttgtctctgaagtgactgagtcaggagacttcacaggccaggtgtgtgggcacaggcatgcctcattttactgcatcttcatcttcaacacatggaaggtttgtggcaaccctgcttcgagcgagactattggcaccatttttccgtcggcttgtgcttgcttcatgtctctgtgtcacattttggtaatt

SEQ ID NO: 131041 - DNA, 1523 bp, Homo sapiens
  Payload ID: 5585
  Gene Symbol: EEF1G
  Gene Name: eukaryotic translation elongation factor 1 gamma
  Uniprot ID: P26641
  ENST ID: ENST00000329251
  CDS Start-End: 132-1445
gtcttctgtttcgtcctcgctttccggctgctgtttctccacggctctcctctttccccctcccttctctcccgggcggcttactttgcggcagcgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaa

SEQ ID NO: 131042 - DNA, 3164 bp, Homo sapiens
  Payload ID: 5586
  Gene Symbol: EEF2
  Gene Name: eukaryotic translation elongation factor 2
  Uniprot ID: P13639
  ENST ID: ENST00000309311
  CDS Start-End: 90-2666
agcgttctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 131043 - DNA, 352 bp, Homo sapiens
  Payload ID: 5586
  Gene Symbol: EEF2
  Gene Name: eukaryotic translation elongation factor 2
  ENST ID: ENST00000600794
  CDS Start-End: 1-256
tgaagagtcgaacgtgctctgcctctccaagtcccccaacaagcacaaccggctgtacatgaaggcgcggcccttccccgacggcctggccgaggacatcgataaaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 131044 - DNA, 2330 bp, Homo sapiens
  Payload ID: 5587
  Gene Symbol: EIF1
  Gene Name: eukaryotic translation initiation factor 1
  Uniprot ID: P41567
  ENST ID: ENST00000469257
  CDS Start-End: 147-488
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaatacctgacttgcagattatttatatatagtcgatcttgtgcatataaaggaaccatagaaatgggcagtggaggattcgtccacacccacagcttctcaacgggcctgaatttggccaagaaaaacctttatgagcttgtccctctctggtcaactggttttttgttcgtttgttttttgagacaggtttgcccttgttgcccaggctggagtgcagtggcacaatctcggctcactgcaacctccacctcaggttcaagcaattgtcgtgcctcagcctccctagtagctgggattacaggcaccatgcccagctaacttttgtatttttagtagagacagggtttctccatgttggccaggctggtcttgaacacctggcctcaagtgatctgcctgtcttggcctcccaaagtgctgggattacaggcatgagccaccatgcccagcaggtcaactgtttttgcaagcatttagccagagtcatgctgtgctgttaatcagtgtcctggagaatgggttgcttggaaatcttggcgccccctcagtagtaacagccttggtttaagggcgcagagtggagagtaaatgcaagggctataacaagggcattcatgctgtgggttaagatccacaaatcgctaggaatgtgtatactctgggtagtaagtttgtagtattagaaggtttaatgacaagtatttgaagagctgaagttaagtgttgggaggccatcccttatgaaggacaatgaatggcaagtaaaagaccaagttctgttcctgggtccattaatttagttaaaaaggcaaagttctttcagcacacatatctgcatgcagtcacgtgctgcctaaggatgcttcattcaacaatgagcctcacagccgtgctacacaataagattataatactgtatttttactgtaccttttaacattgtgttacaatggcctacaagaagcttgtgtggatggctttgaatgtggcccaacacgaactaataaattttgctaaaacatga

SEQ ID NO: 131045 - DNA, 797 bp, Homo sapiens
  Payload ID: 5587
  Gene Symbol: EIF1
  Gene Name: eukaryotic translation initiation factor 1
  ENST ID: ENST00000591776
  CDS Start-End: 153-518
cccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatct

SEQ ID NO: 131046 - DNA, 572 bp, Homo sapiens
  Payload ID: 5587
  Gene Symbol: EIF1
  Gene Name: eukaryotic translation initiation factor 1
  ENST ID: ENST00000586699
  CDS Start-End: 1-162
gattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagaggtgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggaaaaagcagaagggacttgtctacctttggtttactgtttctgtggatctacttcacagatgcaaatttgaatagcatatagatgcattgtaaaataagccaaatgctgggttgttcctgtatttgtaaggacatgagtttttaaaaatgaatttcctgagtattaatactaaaatactgttacatgatcagctcttgatataattgaagagatttcagatacctgatgagtctcattctcacactaattcagaaccttggaaggcactgagtgttc

SEQ ID NO: 131047 - DNA, 2887 bp, Homo sapiens
  Payload ID: 5588
  Gene Symbol: EIF1AD
  Gene Name: eukaryotic translation initiation factor 1A domain containing
  Uniprot ID: Q8N9N8
  ENST ID: ENST00000312234
  CDS Start-End: 336-833
agtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccgcctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatggacactaagcactgcccagcagatctactctgggatgtctgtttcaaaacttctgtcttatctatcaattcccccttgtggtagttaccacaacacatgcctcattaagaaacagcaaccatcagagggaatgcctgcctccctgttaccagctctgcagatgtgcacatatcttcctgtcgtaagccaatgggacttaaaccttacctcttgtgttttggagactatctttttttttttttttttttttttgagagagtgtctccctgtgttgctcaggctggagtgcagtggtgtgatctcggctcactgtaaccttcacctactgggttcaagtaactctcctgcctcagcctcccgagtagcttggactacaggcgtgcaccaccacacctggctaactttttgtatttttagtagagacggggttttgccatgttgcccgggctggtctcgaactcctgaccttaaatgagcctcctgcctcagcctcccaaactgctgggattacaggcgtgtgccaccatgcctggctaatttttatattttcagtagagacgaggttttgccatgttggccaggctggtctcgaactcctgacctcaagtggtccacccaccttggcctcctagagtgctgggattacaggtgtgagccactgtgcccggcctcttttgctttcttaaagactttggtcgggtatttgtgttgttgagtattgtgtctgggtgtgggtatttgattctttttttgttttgtgtttttggctgtcctgtctattggatgtgatatgttatggatgtgatgtgttagtgtcgagcgtgctgtagaatctcccatttctgaaacaggcgtgaaaacctgtactgattcccacgtcctccagctaccacttcatttgtctgtttctcatttactttctcttatagcgtggctttaaacatatatacatttgtatatatgtatatatgaatataatgtataaaatgtatgtagatgtatatacaaaaaataaacgagatgggttaaagata

SEQ ID NO: 131048 - DNA, 588 bp, Homo sapiens
  Payload ID: 5588
  Gene Symbol: EIF1AD
  Gene Name: eukaryotic translation initiation factor 1A domain containing
  ENST ID: ENST00000527051
  CDS Start-End: 354-588
ttctcccttttctcctgtcttataaactagggaaaaggggaggttggagagaaactaagaaggccaacaggagaagtggtggcctcataccatactgtaacagtgctgagttagctgttatttttctgggacctagagaagttgaatagttaggaaataaaccaaggtaggatttgaatccaggcagttagacttcagaacccatgttcttaaccaagacaccgtgtcacccctcagtaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaa

SEQ ID NO: 131049 - DNA, 584 bp, Homo sapiens
  Payload ID: 5588
  Gene Symbol: EIF1AD
  Gene Name: eukaryotic translation initiation factor 1A domain containing
  ENST ID: ENST00000532707
  CDS Start-End: 245-584
agactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacaca

SEQ ID NO: 131050 - DNA, 965 bp, Homo sapiens
  Payload ID: 5588
  Gene Symbol: EIF1AD
  Gene Name: eukaryotic translation initiation factor 1A domain containing
  Uniprot ID: Q8N9N8
  ENST ID: ENST00000533544
  CDS Start-End: 362-859
acggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaa

SEQ ID NO: 131051 - DNA, 743 bp, Homo sapiens
  Payload ID: 5588
  Gene Symbol: EIF1AD
  Gene Name: eukaryotic translation initiation factor 1A domain containing
  ENST ID: ENST00000525767
  CDS Start-End: 192-533
cggaagtacggttttcggagggatcagactcagactcacgtcgcactcctcgcagttggactggtgggaactgggaacactggagacctgatttctaactgacgctaccgtcgcggccgccggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagat

SEQ ID NO: 131052 - DNA, 889 bp, Homo sapiens
  Payload ID: 5588
  Gene Symbol: EIF1AD
  Gene Name: eukaryotic translation initiation factor 1A domain containing
  Uniprot ID: Q8N9N8
  ENST ID: ENST00000527249
  CDS Start-End: 360-857
cctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagg

SEQ ID NO: 131053 - DNA, 580 bp, Homo sapiens
  Payload ID: 5588
  Gene Symbol: EIF1AD
  Gene Name: eukaryotic translation initiation factor 1A domain containing
  ENST ID: ENST00000530462
  CDS Start-End: 238-580
ggaagtacggttttcggagggatcagactcagactcacgtcgcactcctcgcagttggactggtgggaactgggaacactggagacctgatttctaactgacgctaccgtcgcggccgccgtaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaaca

SEQ ID NO: 131054 - DNA, 808 bp, Homo sapiens
  Payload ID: 5588
  Gene Symbol: EIF1AD
  Gene Name: eukaryotic translation initiation factor 1A domain containing
  Uniprot ID: Q8N9N8
  ENST ID: ENST00000529964
  CDS Start-End: 145-642
agcgccggaagtacggttttcggagggatcagactcagactcacgtcgcactcctcgcagttggactggtgggaactgggaacactggagacctgatttctaactgacgctaccgtcgcggccgccgtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttgg

SEQ ID NO: 131055 - DNA, 2761 bp, Homo sapiens
  Payload ID: 5588
  Gene Symbol: EIF1AD
  Gene Name: eukaryotic translation initiation factor 1A domain containing
  Uniprot ID: Q8N9N8
  ENST ID: ENST00000526451
  CDS Start-End: 210-707
gtacggttttcggagggatcagactcagactcacgtcgcactcctcgcagttggactggtgggaactgggaacactggagacctgatttctaactgacgctaccgtcgcggccgccgaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccgcctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatggacactaagcactgcccagcagatctactctgggatgtctgtttcaaaacttctgtcttatctatcaattcccccttgtggtagttaccacaacacatgcctcattaagaaacagcaaccatcagagggaatgcctgcctccctgttaccagctctgcagatgtgcacatatcttcctgtcgtaagccaatgggacttaaaccttacctcttgtgttttggagactatctttttttttttttttttttttttgagagagtgtctccctgtgttgctcaggctggagtgcagtggtgtgatctcggctcactgtaaccttcacctactgggttcaagtaactctcctgcctcagcctcccgagtagcttggactacaggcgtgcaccaccacacctggctaactttttgtatttttagtagagacggggttttgccatgttgcccgggctggtctcgaactcctgaccttaaatgagcctcctgcctcagcctcccaaactgctgggattacaggcgtgtgccaccatgcctggctaatttttatattttcagtagagacgaggttttgccatgttggccaggctggtctcgaactcctgacctcaagtggtccacccaccttggcctcctagagtgctgggattacaggtgtgagccactgtgcccggcctcttttgctttcttaaagactttggtcgggtatttgtgttgttgagtattgtgtctgggtgtgggtatttgattctttttttgttttgtgtttttggctgtcctgtctattggatgtgatatgttatggatgtgatgtgttagtgtcgagcgtgctgtagaatctcccatttctgaaacaggcgtgaaaacctgtactgattcccacgtcctccagctaccacttcatttgtctgtttctcatttactttctcttatagcgtggctttaaacatatatacatttgtatatatgtatatatgaatataatgtataaaatgtatgtagatgtatatacaaaaaataaacgagatgggttaaagata

SEQ ID NO: 131056 - DNA, 530 bp, Homo sapiens
  Payload ID: 5588
  Gene Symbol: EIF1AD
  Gene Name: eukaryotic translation initiation factor 1A domain containing
  ENST ID: ENST00000529973
  CDS Start-End: 94-288
gaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagag

SEQ ID NO: 131057 - DNA, 765 bp, Homo sapiens
  Payload ID: 5589
  Gene Symbol: EIF1AX
  Gene Name: eukaryotic translation initiation factor 1A, X-linked
  ENST ID: ENST00000379593
  CDS Start-End: 187-537
cgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaagagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatggg

SEQ ID NO: 131058 - DNA, 4427 bp, Homo sapiens
  Payload ID: 5589
  Gene Symbol: EIF1AX
  Gene Name: eukaryotic translation initiation factor 1A, X-linked
  Uniprot ID: P47813
  ENST ID: ENST00000379607
  CDS Start-End: 205-639
cgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgta

SEQ ID NO: 131059 - DNA, 1390 bp, Homo sapiens
  Payload ID: 5590
  Gene Symbol: EIF1AY
  Gene Name: eukaryotic translation initiation factor 1A, Y-linked
  Uniprot ID: O14602
  ENST ID: ENST00000361365
  CDS Start-End: 148-582
agagagtgcgcgtcagcagtttattagagagctctgtagccagcctcttctgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggtttggataaatacatcagacattatattggttggtctacgggactatcaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtcaagtaattggatattttgaatacatttctgcctgataatcatgctgggttctaataagccctacttccacctaatctgtttacagtcttttggtatgtttcagttacttagatggtctcataaggtttctgatacaatttgaagacagaaatctgcatttagaatcagaaaacatggacatatttttcatatttatctagtcatatgtaattttatgctaacattgatagtttataaatccttttcatcctttgtgcctcggttattaaggaaaaaaaaatgtccaacatacagtttttaaagtgtggcagttttgagtagtaacttagaatgtataagattaagagttaaagaaaccgaacaataagtggcaaccaattatcttaacattggaaatactggggtgccattttgttttcaaaagttattcattgtaatccactgttttggctttcatgaacaagtaaattacagtgtataaatgaaaagcaatttcataataaattctataaactga

SEQ ID NO: 131060 - DNA, 746 bp, Homo sapiens
  Payload ID: 5590
  Gene Symbol: EIF1AY
  Gene Name: eukaryotic translation initiation factor 1A, Y-linked
  ENST ID: ENST00000382772
  CDS Start-End: 79-462
tcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtga

SEQ ID NO: 131061 - DNA, 1010 bp, Homo sapiens
  Payload ID: 5591
  Gene Symbol: EIF1B
  Gene Name: eukaryotic translation initiation factor 1B
  Uniprot ID: O60739
  ENST ID: ENST00000232905
  CDS Start-End: 259-600
agtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaatttttttgttgttgtattaaaccatgtacgttgcagcttaacaataaaaaaaaatctatgaatctttgtgagcaattatgctcccaaatctaagcaagtaaaatacacattttgtctttcttaa

SEQ ID NO: 131062 - DNA, 5499 bp, Homo sapiens
  Payload ID: 5592
  Gene Symbol: EIF2AK4
  Gene Name: eukaryotic translation initiation factor 2 alpha kinase 4
  Uniprot ID: Q9P2K8
  ENST ID: ENST00000263791
  CDS Start-End: 44-4993
cgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcaggatgaagattgcaatgaaaagaatggctgccatgaaagtgagccatcagtgacgactgaggctgtgcactacctatacatccagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggccagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaaatttttttctaagaagctgtcctacaaagttgagctttgttagtttttcatgtgtaatatattataaatttatcttttgggatataataaatgctttcatat

SEQ ID NO: 131063 - DNA, 3548 bp, Homo sapiens
  Payload ID: 5592
  Gene Symbol: EIF2AK4
  Gene Name: eukaryotic translation initiation factor 2 alpha kinase 4
  Uniprot ID: Q9P2K8
  ENST ID: ENST00000559624
  CDS Start-End: 51-1901
ggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgtggtacagagtcattcccagtcccctttagagctccttctctgttccatttccacaaagactcatggactttacttttattttgggagtggggagggaagtgaatatggctgttggatactatgctcatcctcaccttcctggagttaaaggttttatttaagttacgctggacacagttgagaattgtcccactcctctttccttgcttcatgtggagcattaacatgaaacacacatggttataacagcacttcaagtggaatcaagacctccacagaaagaacatttttgtgtgctttggttcagaaagaacattgttctttttttctcctgtttgctgttagagttgctgtagataaaaaggttctaaggttagaagagagatggacttcaaactgggagatggccccagcaggtctcgatggcttttattttccagctattattgggacaggaaagtagcgatgtattattaaggtacactgttgttgggtcttcctttcttcgttctagtctatttgggtgacttttattattatctgccccttgtagaaagaggtttcagctgtttttatataatagaagtatttctttgtaaattaggagacccagattattgtattaagtccatatacagtacatgtcatctttcacatatgaaggtaacccaccatcaactgagtatattgtctgttaaggattctgagagtatcattaggaagcattactgttactgtagaaaaacttttacactaaaaaaggaattaaattagttttcctgtggtaaaagacagacaagcaagacagatgtcctgatcagaaagatcataattatgtctaagaggaggggatgattgaagcgtatactgtccctttaacacaatatcattttgatcaaatcctttaacttcattctattttaaattcttgaacgtagaatagtaacaaatttcatctctttacaagtacttaataatgataggcaagctcatataacaaaaacatctgagtaacttaagcccccacggtttccagtagtttctccctgtgagaatccacagccctcacctcctacctctgtgcttctgtgtcagagtagggcagcctgcccagtgatctggcattcattagcagttggacccattactgtttctgcaccttttcacttcagtaaatgaattcctaggggtttccagtatagcaagctttactcccaacccagttcgtatatgatgtgtactgagacaggagatcgaaaggcaatgccaagatccccacctcccgccctacactgtcctcttccctattaatgtggcagtaaaagaacacagggctatcattttttggagcacctgccatatttcagattgtgtgccaggtgatttacaaaccttgtctttaaatctcaggacattcttacgagatgggtatgatcctcattccctagatgagggaactgaagctcagagaaggttatgtcctttgcctgagataagggagataaaaccagcattcagacccacctctgttgtactacaaagtgtgtgttcttgtcactatttccatacaaaaaaagataatctgaaactcaattttgtagtacttccttcttattcccaggacttcacttagacttttattagtttaattgaaacttgtgagccaaacaagagaa

SEQ ID NO: 131064 - DNA, 4789 bp, Homo sapiens
  Payload ID: 5592
  Gene Symbol: EIF2AK4
  Gene Name: eukaryotic translation initiation factor 2 alpha kinase 4
  ENST ID: ENST00000560855
  CDS Start-End: 1-4282
ggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggccagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaaatttttttctaagaagctgtcctacaaagttgagctttgttagtttttcatgtgtaatatattataaatttatcttttgggatataataaatgctttcatata

SEQ ID NO: 131065 - DNA, 687 bp, Homo sapiens
  Payload ID: 5592
  Gene Symbol: EIF2AK4
  Gene Name: eukaryotic translation initiation factor 2 alpha kinase 4
  ENST ID: ENST00000560648
  CDS Start-End: 21-431
gccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggagcagcagggttggagaggattgaccccaactttgaaagaagttcaagtgtgactcaaaggctatcaaacagcattgaatgctacagagaaatcttccatgaaaggaagagtcaatcgatgcagcaacttcattgttgtcttcttttaagaaattgccgcaaccaccccagccttcaccagccaccaccttgatcagtcagcagccatcatcaagacaaaaccctctgtctgcaaaaagattatgacgtcctgaaggttcagatgatcattagcattttttagcaataaagtattttaaaattaaggta

SEQ ID NO: 131066 - DNA, 638 bp, Homo sapiens
  Payload ID: 5592
  Gene Symbol: EIF2AK4
  Gene Name: eukaryotic translation initiation factor 2 alpha kinase 4
  ENST ID: ENST00000558823
  CDS Start-End: 1-241
cattgtgagtgtgctagccccggagaagctgtcagccagcactaggaggcgctatgaaactcagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaa

SEQ ID NO: 131067 - DNA, 4485 bp, Homo sapiens
  Payload ID: 5593
  Gene Symbol: EIF2S1
  Gene Name: eukaryotic translation initiation factor 2, subunit 1 alpha, 35kDa
  Uniprot ID: P05198
  ENST ID: ENST00000256383
  CDS Start-End: 462-1409
gcgcaatacgcggcacgcgccaggccaaagactaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagta

SEQ ID NO: 131068 - DNA, 2390 bp, Homo sapiens
  Payload ID: 5593
  Gene Symbol: EIF2S1
  Gene Name: eukaryotic translation initiation factor 2, subunit 1 alpha, 35kDa
  Uniprot ID: P05198
  ENST ID: ENST00000466499
  CDS Start-End: 761-1708
aattgtaaatatctttaatgcttggaggttaagagaaacttgaactttgtagtaatggagattaaagctattctcaagattaggtatacctattcaataaaagaaaggaatatttgggagtattggggataagagaagctagacattgtgaattcaaggaaaaagaattatgagaggaggatgcattttagtttattttgtgattaaaatttttttagtttttgttgttttgacatgtgacactgtaattttggctataataaatgacagaatgtatcatttggtatattggttagggtttaggtagaaaattttttcctttatatagtgagtggtagcgtatacaatgtttgctcacttcggcaaagagtagctttagttttctgattagttataatagtgatgcttcccatcatttgatatgccttaaagtagtattttactcttgaggtattcctttaatccttaggtcttggagtactttatagatggtcattattttttatgattcctctgaaactaaaggcagagaatcacccaagcattacaaaaatgttgagcaaaataaaaattaaagcttggttcctgaacattatctgttttctggtaccacttaagaagtttcaaaggatgagaagactaagactaataactatttttttcttcatcttttctttcagtggcaggatgtggaaattgattttttttttattttcaccttaactgaatacttacttaattcttttgtttaaattgcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattg

SEQ ID NO: 131069 - DNA, 999 bp, Homo sapiens
  Payload ID: 5593
  Gene Symbol: EIF2S1
  Gene Name: eukaryotic translation initiation factor 2, subunit 1 alpha, 35kDa
  ENST ID: ENST00000557310
  CDS Start-End: 181-999
tttcccgtccctgcgcgggaagtggctggacagcaccgccaccacccgcgctgtcgtgggcctcctcgccggctccgtgtaggtcatcctgtgttccagaggcatcgttgttcgagcagaggaatctcgtgaaggaaagtgggccgagtggattgtacagcctctacaatatgccgaaaaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatg

SEQ ID NO: 131070 - DNA, 783 bp, Homo sapiens
  Payload ID: 5593
  Gene Symbol: EIF2S1
  Gene Name: eukaryotic translation initiation factor 2, subunit 1 alpha, 35kDa
  ENST ID: ENST00000555876
  CDS Start-End: 1-758
gcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggaggtgagatcaatagattcatttttaataatgactcaggaggttcctaaaaggagttcttgtaggtaaataagagctgtcggccttggaatgt

SEQ ID NO: 131071 - DNA, 2656 bp, Homo sapiens
  Payload ID: 5594
  Gene Symbol: EIF2S2
  Gene Name: eukaryotic translation initiation factor 2, subunit 2 beta, 38kDa
  Uniprot ID: P20042
  ENST ID: ENST00000374980
  CDS Start-End: 223-1224
gaagcgcgctaggttggctcttctgcgcgcctgcgccttggcgagctctgcgcaggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcctcccacgcgagtgtggtgggaccttgagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaattaacgctcca

SEQ ID NO: 131072 - DNA, 2858 bp, Homo sapiens
  Payload ID: 5595
  Gene Symbol: EIF2S3
  Gene Name: eukaryotic translation initiation factor 2, subunit 3 gamma, 52kDa
  Uniprot ID: P41091
  ENST ID: ENST00000253039
  CDS Start-End: 254-1672
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaa

SEQ ID NO: 131073 - DNA, 773 bp, Homo sapiens
  Payload ID: 5595
  Gene Symbol: EIF2S3
  Gene Name: eukaryotic translation initiation factor 2, subunit 3 gamma, 52kDa
  ENST ID: ENST00000423068
  CDS Start-End: 1-550
ggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaa

SEQ ID NO: 131074 - DNA, 2083 bp, Homo sapiens
  Payload ID: 5596
  Gene Symbol: EIF2A
  Gene Name: eukaryotic translation initiation factor 2A, 65kDa
  ENST ID: ENST00000273435
  CDS Start-End: 10-1752
cgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaatgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacattttaaatttaa

SEQ ID NO: 131075 - DNA, 1795 bp, Homo sapiens
  Payload ID: 5596
  Gene Symbol: EIF2A
  Gene Name: eukaryotic translation initiation factor 2A, 65kDa
  Uniprot ID: Q9BY44
  ENST ID: ENST00000406576
  CDS Start-End: 17-1591
ctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtca

SEQ ID NO: 131076 - DNA, 2198 bp, Homo sapiens
  Payload ID: 5596
  Gene Symbol: EIF2A
  Gene Name: eukaryotic translation initiation factor 2A, 65kDa
  Uniprot ID: Q9BY44
  ENST ID: ENST00000460851
  CDS Start-End: 110-1867
gatggctccggaaacaccaattcgctgtctccacgcatgaggagacgtgtaggggccgggttcggccctggtgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacattttaaatttaa

SEQ ID NO: 131077 - DNA, 568 bp, Homo sapiens
  Payload ID: 5596
  Gene Symbol: EIF2A
  Gene Name: eukaryotic translation initiation factor 2A, 65kDa
  ENST ID: ENST00000490505
  CDS Start-End: 4-231
aacatggcgccgtccacgccgctcttgacagtccgaggatcagaaggactgtacatggtgaatggaccaccacattttacagaaagcacagtgtttccaagagacagggtttcgccatgttgcccagctggtctcgaactcccaacctcaggtgatccgcctgcctcggcctcccaaactgctgggattacaggtggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaat

SEQ ID NO: 131078 - DNA, 725 bp, Homo sapiens
  Payload ID: 5596
  Gene Symbol: EIF2A
  Gene Name: eukaryotic translation initiation factor 2A, 65kDa
  ENST ID: ENST00000482093
  CDS Start-End: 16-725
tctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttattggctctagagtttcagcttcaggttcttttttagacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttac

SEQ ID NO: 131079 - DNA, 710 bp, Homo sapiens
  Payload ID: 5596
  Gene Symbol: EIF2A
  Gene Name: eukaryotic translation initiation factor 2A, 65kDa
  ENST ID: ENST00000494558
  CDS Start-End: 37-216
aactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaa

SEQ ID NO: 131080 - DNA, 1906 bp, Homo sapiens
  Payload ID: 5596
  Gene Symbol: EIF2A
  Gene Name: eukaryotic translation initiation factor 2A, 65kDa
  ENST ID: ENST00000477551
  CDS Start-End: 1-475
agtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttagtggctgtctatgttccaggaagtaaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacattttaaatttaa

SEQ ID NO: 131081 - DNA, 817 bp, Homo sapiens
  Payload ID: 5596
  Gene Symbol: EIF2A
  Gene Name: eukaryotic translation initiation factor 2A, 65kDa
  ENST ID: ENST00000462221
  CDS Start-End: 1-123
cacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaa

SEQ ID NO: 131082 - DNA, 1913 bp, Homo sapiens
  Payload ID: 5596
  Gene Symbol: EIF2A
  Gene Name: eukaryotic translation initiation factor 2A, 65kDa
  Uniprot ID: Q9BY44
  ENST ID: ENST00000487799
  CDS Start-End: 119-1801
cccgaggctgatggctccggaaacaccaattcgctgtctccacgcatgaggagacgtgtaggggccgggttcggccctggtgaactctcacccgagcggtttctctttccgggacaacatggcgccgtccacgccgctcttgacagtccgaggatcagaaggactgtacatggtgaatggaccaccacattttacagaaagcacagtgtttccaagagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataat

SEQ ID NO: 131083 - DNA, 1273 bp, Homo sapiens
  Payload ID: 5596
  Gene Symbol: EIF2A
  Gene Name: eukaryotic translation initiation factor 2A, 65kDa
  ENST ID: ENST00000465535
  CDS Start-End: 1-950
tgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacatttt

SEQ ID NO: 131084 - DNA, 4469 bp, Homo sapiens
  Payload ID: 5597
  Gene Symbol: EIF2AK1
  Gene Name: eukaryotic translation initiation factor 2-alpha kinase 1
  Uniprot ID: Q9BQI3
  ENST ID: ENST00000199389
  CDS Start-End: 148-2040
cccccagtgaaggtgcgcgcgtggcggaggctggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggtaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttatctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatattcttacaataaacttgagaaaatgttaagaaaataataa

SEQ ID NO: 131085 - DNA, 806 bp, Homo sapiens
  Payload ID: 5597
  Gene Symbol: EIF2AK1
  Gene Name: eukaryotic translation initiation factor 2-alpha kinase 1
  ENST ID: ENST00000431744
  CDS Start-End: 82-327
ggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgagatgtggtcttgctgtgtttcccaggctggtctcgaacgcctggcctcaagcgattctcccgcctcggccttccaaaatgctgggattatagataatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaag

SEQ ID NO: 131086 - DNA, 782 bp, Homo sapiens
  Payload ID: 5597
  Gene Symbol: EIF2AK1
  Gene Name: eukaryotic translation initiation factor 2-alpha kinase 1
  ENST ID: ENST00000422786
  CDS Start-End: 1-217
gctggcaggactcactccccttggggtagcagctgtggcctcagcaggcacaggaggtatctgctggtgttcacaaagaggagcggagggctgggggccaaccccacagcgaaggccggttaacctcaccctacagatgaagataatagagcaagaaaaagaaattgcagaactaaagaagcagctaaacctcctttctcaagacaaaggggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaag

SEQ ID NO: 131087 - DNA, 573 bp, Homo sapiens
  Payload ID: 5597
  Gene Symbol: EIF2AK1
  Gene Name: eukaryotic translation initiation factor 2-alpha kinase 1
  ENST ID: ENST00000446699
  CDS Start-End: 82-573
ggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagggatgaaaaatttcattttagcccatcctttccaaatcagcac

SEQ ID NO: 131088 - DNA, 10042 bp, Homo sapiens
  Payload ID: 5598
  Gene Symbol: EIF2AK2
  Gene Name: eukaryotic translation initiation factor 2-alpha kinase 2
  Uniprot ID: P19525
  ENST ID: ENST00000233057
  CDS Start-End: 324-1979
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattctttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaaagtgatgtacaaccacttcggaaaacaatttggcattatctagtaaagttgaatccatgtatacccacatagctatcaattctattcctacatacgtgcttacaagaatgtccataaaaccctgtttataatagccaaaagaacagggaacaaccataatgcacatcaaaagaagaatggattaaaaaaattatattcacacacaggagtactatatagtattgaaaacaattgaagtacagctaaatgtaataacgtaacacaatacaactctcagaaacataatgttaagcgaacaaagcaggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacacctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggatggcttgagcataggattttgagactagcctgggcaacacagtgagttctcatctctacaaaaaatcagaaaattagctgggcatggtagtgtgcatctgtggtcccagctacttgggggggtgaggtgggaggatcacttgagcctaggaggtcaaggccgcagtgagccatgatcatgttactgcattccagcctgggtgacagagtgagatcatatctaaataataataataataaaagaaagcaacaacccagcaaacagctataaagatatcttcgggacaattgagaacatttgaatatagactgcatattagataacaatgccaaataactgttttctcaggtgtgataatagtatatgtagaaaatgtctttttgttttgttttattttgtttttgtttgtttgtttgttttgagacagagtctcactgtgtcgcccaggctggagtgcagtggcacgatctcggctcactgcaacctctgcctcccaggttcaagtgattctcctgcctctgcttcctgagtagctgggattacaggtatctgccaccactccaggttaattttttctatttttagtagagacggaatttcaccatgttgacccagctggttttgaactcctgacctcaggtgattcacttgccttggcctcccaaagtgttgagattacaggcatgagtcactgcacccagccaaaaatgtttttttaggcaatgcatgcacaaacatttagaggccaagtgtgtcatgatgtctgcaactttcaatgttcagcaaaaatcaacatggagagagaaagagggcacacatgtggcaaaatattagccattgtacaattggtaaatctagatgacagtacacaggtgtttgttgtattattctttgaacttttctgtagatttggaaatgttctgcgtagagagaaatctttttttaaaaaaacaatatctggttttgattaatgaggctatattcaaaagaaacactaaatgatgtggccagttagtgagaatgtagccttatctttactgacctcattttaatattcctactctggctgggcatggtggctcacgcctataatcccagcactctgggaggccgagacgggtggatcacctgaggtcaggggttcgagaccagcctggccaacatggtgaaaccccatctctactaaaaatacaaaaattagctgggtgtggtggtaggcgcctgtaatcccagctactcgggagtccgtggcaggagaatcgcttgaacccaggaggtggaggttgcagtgagctgagatcacgccattgcactccagcctgggtgacaagagcaaaactcagtctcaaaaaaaaaaaagaaaaaaaaagatatatatattcctactcttattaaatgaatatagcatttcttagcaacttcttttgatttgtgagtatatattttcttggcctcaaaattaaagtaaaaagtatcctcttactcagaggaggacaggggcaagagcctgggaccttatttgctaattaaaatgcacacacacacacacacacacagaaattttgagagccattttaatataattgcctccctagaaacataccttttagggaatttttatcactaaaccacatgttatttaaatacgtacatgtttaacataaatacatacataaaattcacatgcatacttaacacttatgttaaatatattcaatgtatatacatatgtacacaatatatgcatatatacatgtgggtatgtggtatgtgtgcatgtgtgtgtatggccagctacataatttgtgggactaagggcaaaatgaaactgtacggccctcgttcaaaaattaggtgtggggtgcttctaagcacagtcttgtgcaactgcacaggttgcatgtccatgaagccatcctgtgtgtgtgcacatatgtgtatgaatatgtattttatataatacatatatatgcatgtatgtatctgagaagaaatgtttaaaaggctacatacaagcttttccaggtctctactatctgttaactaactagagacataactcacaatatgcagtccccactgagtgttcaccataatttgagattcttggcatgttaacttttcattatggaatattgaataatttcaatattattcatacatttctttatgttcaaacatacacaaaaatagaataatgaaactctacccatcacccagctgcaacaaatatcaatactttaccgttcttaatacatctaaccccttactttttgtttgtttcttttggtgaagtatttaattgtaattttttttttaagagacaggatctcactctgtcacccaggccagagtacagtggtacgatcacagctccttgtaacctcgaactcctaggctcaagtgatcctcctgcctcagccgcttgaatagctgggactacatgcatacaccaacacacccaactaatttttaaattttttgtagaaatatggtcttgctgtgtttcccaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaagaatactccataggtgatgctatacactttctcttacatcatttcaggaggaacatgatgtctgattgttccactttcagtgattttaatattgatcaatgagttctggtggtaccaactactacaaagtttctcatcaatctttcacctgatggttttagcagctattgataattgttgcctggatccattatttcatttcaggggttgtaaaatagtgattttctggttctatcaaacctcttgcatttatcatctatgattcttctttaaggaactttctctaaatctgaatgggaaagatgcgataaatatttatcaaattttagagtgagttagtgccctagcaacctccacagttgacaaatgagtatttctttaaagcaaggtatggcccaaccaatactttgaaactagcatgtttagaatagagcaggaggaaactatatttgaaaggtcagaagtggaaagactaagagggcctgaacaataagaggacagaaccaagaggagttggcaactaattggatgtggggattaaggaaaggtaagcatcaaagattacctccaagtttgttagaaggttagtagcaggattctgatgccattcaagtaaatacaagtctcagtcagatgaaccccaagagccacatgtatttgaggggtactttgtctcacacttttacctgttacatggttttcagtaatttagaatttaagccagtagtggggcgactgtacatctatcgacatggtgaggtagagcatgtttgggaggaaagacgttgaatcccatttggtgacagtgagcttgaggtgctgccagaacactgcactgaagataggaggagactgtaggaaatacaagataggaaaggtctccactgaaatgttaactctttctctctaaacggccatccaggcctcaatgtctgcagtttctgatctgtgattatgacttatccaaatcttacatttcttaaaaatagtcatagatgaagggaatcacagttgatagttatatggtgacattattggcttaaattctaaataactagaaactgtataataggcaaaactgtgaggcaaataaaatgcttctcaaatctgtgtggctcttatggggttaatttgatttggacctgtattaatttcttatggctgctataactaacaaattaccacaaacttggtggtttaaaacaacacacatttattctctttctgttctggaggccagaagtctaaaatgagattcactgggctgcagttcactgggcaaggccatgctcctctggaggcttccatgatgcatcccatattcagtgtttcccgagtaagccccacccatgcaggtctgcagttttacctcaacaggcttttgcactcagtggctctctcctgtggtttctatctgaaattctcttcattttttttttaataactgctttattgagatataattcacatgccatacaattcacctatacagtatacaattcagtagtgtttactatattcagagttgtgcaactatcatttttctcacccccaaaagaaaccctatgcccgttagtattcactctgttttctcacaactctaggtaaccactaatctactctccatctctatagatttgcccatgctagacatttcatataaatggaatcatacatgtggtctttttcactgagtatattttcaaggtgcatcccagctgtggcatgaatcagcatctcattcctttttattgccaaataatattctatcatatggatatgtcgcattttatgtatccattcatcagctgatggacatttgggttgtttgtactttttggctaccatgaataatgctactatgaacttttgtgtacaaatcttatgtggacttgttttcatttctcttggatgtatattcctaggagaatggctggattatacagtaactctttcctcataactttgcatatcaaaattatatccatctttcagaacccaaattcagtgttatttccaaagtgttccaacatctcccactcaaaatgaatcttctccctagtactcccattgtttagtacctaattgttcttaccagtttgtcttagagctcagtcattcctacacagcacttttcttcattatactgctaatttcattacactgtaagagtggggacaagctgttcttcttgtataccagaaagtagtgagtgcactgctgtgaagaaagcaggaactcaaaagttaagaattttgaatgagcctataaaatgtgtctaataaataataatgttcattttcaaatctcaacaattaaatgtttaacaaataacacttgaaataaatgtttattagaaaaaccaa

SEQ ID NO: 131089 - DNA, 564 bp, Homo sapiens
  Payload ID: 5598
  Gene Symbol: EIF2AK2
  Gene Name: eukaryotic translation initiation factor 2-alpha kinase 2
  ENST ID: ENST00000390013
  CDS Start-End: 258-564
aatttaccccaatcccgtagcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacatag

SEQ ID NO: 131090 - DNA, 4343 bp, Homo sapiens
  Payload ID: 5598
  Gene Symbol: EIF2AK2
  Gene Name: eukaryotic translation initiation factor 2-alpha kinase 2
  Uniprot ID: P19525
  ENST ID: ENST00000395127
  CDS Start-End: 558-2213
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattctttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaaagtgatgtacaaccacttcggaaaacaatttggcattatctagtaaagttgaatccatgtatacccacatagctatcaattctattcctacatacgtgcttacaagaatgtccataaaaccctgtttataatagccaaaagaacagggaacaaccataatgcacatcaaaagaagaatggattaaaaaaattatattcacacacaggagtactatatagtattgaaaacaattgaagtacagctaaatgtaataacgtaacacaatacaactctcagaaacataatgttaagcgaacaaagcaggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacacctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagc

SEQ ID NO: 131091 - DNA, 1533 bp, Homo sapiens
  Payload ID: 5598
  Gene Symbol: EIF2AK2
  Gene Name: eukaryotic translation initiation factor 2-alpha kinase 2
  Uniprot ID: P19525
  ENST ID: ENST00000405334
  CDS Start-End: 1-1533
atggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttag

SEQ ID NO: 131092 - DNA, 623 bp, Homo sapiens
  Payload ID: 5598
  Gene Symbol: EIF2AK2
  Gene Name: eukaryotic translation initiation factor 2-alpha kinase 2
  ENST ID: ENST00000411537
  CDS Start-End: 201-623
gtgcgagagggggccgggcggctgcagggaaggcggagtccaaggggaaaacgaaactgagaaccagctctcccgaagccgcgggtctccggccggcggcggcggcggcggcggcggcggcgcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaa

SEQ ID NO: 131093 - DNA, 4646 bp, Homo sapiens
  Payload ID: 5599
  Gene Symbol: EIF2AK3
  Gene Name: eukaryotic translation initiation factor 2-alpha kinase 3
  Uniprot ID: Q9NZJ5
  ENST ID: ENST00000303236
  CDS Start-End: 303-3653
ggaaagtccaccttccccaacaaggccagcctgggaacatggagtggcagcggccgcagccaatgagagagcaaacgcgcggaaagtttgctcaatgggcgatgtccgagataggctgtcactcaggtggcagcggcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctgctggggctcgcggcaaggacggtggccgcggggcgcgcccgtggcctcccagcgccgacggcggaggcggcgttcggcctcggggcggccgctgctcccacctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatt

SEQ ID NO: 131094 - DNA, 4222 bp, Homo sapiens
  Payload ID: 5599
  Gene Symbol: EIF2AK3
  Gene Name: eukaryotic translation initiation factor 2-alpha kinase 3
  ENST ID: ENST00000419748
  CDS Start-End: 330-3227
agttcagatgagaggtttagtgtaaagtggtataggacagaggggacagagttgagatatttgatgcaaaatctaggttcctggcaagtgaatgcattcttcctttcttggtacccttgtccagagattgagactgcgtggccagaagttgacaaaagaggtttaagggagcagggaagaaaaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaattaa

SEQ ID NO: 131095 - DNA, 2902 bp, Homo sapiens
  Payload ID: 5599
  Gene Symbol: EIF2AK3
  Gene Name: eukaryotic translation initiation factor 2-alpha kinase 3
  ENST ID: ENST00000415570
  CDS Start-End: 33-2902
aattacttttggttgatggactgcactgcttcatgtgctactcagaaggaggctggagtacatcaggatcaagactccagctcttaattactattattcttttaaaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttga

SEQ ID NO: 131096 - DNA, 2477 bp, Homo sapiens
  Payload ID: 5600
  Gene Symbol: EIF2B1
  Gene Name: eukaryotic translation initiation factor 2B, subunit 1 alpha, 26kDa
  Uniprot ID: Q14232
  ENST ID: ENST00000424014
  CDS Start-End: 210-1127
cgaggtgctgtgactcgtgccagccccctaatctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgctgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctggg

SEQ ID NO: 131097 - DNA, 848 bp, Homo sapiens
  Payload ID: 5600
  Gene Symbol: EIF2B1
  Gene Name: eukaryotic translation initiation factor 2B, subunit 1 alpha, 26kDa
  ENST ID: ENST00000539951
  CDS Start-End: 28-636
gagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctg

SEQ ID NO: 131098 - DNA, 618 bp, Homo sapiens
  Payload ID: 5600
  Gene Symbol: EIF2B1
  Gene Name: eukaryotic translation initiation factor 2B, subunit 1 alpha, 26kDa
  ENST ID: ENST00000534960
  CDS Start-End: 1-458
agcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaag

SEQ ID NO: 131099 - DNA, 1768 bp, Homo sapiens
  Payload ID: 5600
  Gene Symbol: EIF2B1
  Gene Name: eukaryotic translation initiation factor 2B, subunit 1 alpha, 26kDa
  Uniprot ID: Q14232
  ENST ID: ENST00000537073
  CDS Start-End: 210-878
cgaggtgctgtgactcgtgccagccccctaatctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcagggcaagtacctttctgttcagttatgtgcccagccataattttacagagcaaactgcggattacagtccaacaggatcagaaccagaatgtgcccccagcttgccagcagtcagcactgcctttcattgtaccttttcctgcctttggaagaaaaatcactgaatttgcagcaggccgcagtatatgatctaggggtttcacttaagtagttaactccgtggaagagcagagattgtattgatgaagatttttatcaaggaataggtaacttatatctccctctctctagacgataatcaaagcaaaacttcctccttttttcctgaatttacatctcttacccagagtctaagagtatagttttccaaaaatacttctttctaaagaactcaaattcttgtttccttagtccaaagtattgggatctgccccttaacccattagtattaatgtgagtttcaagcaaacatccactgtccacattaggtgacatacatcactgtggtactgtcttgtactttctctaacgttctcaaaatgtcatcttcagtaagaaaatggccaaagccctctgccacctcaacgtccctgtcactgtggtgctagatgctgctgtcgggtgagtgcccatcttccccagccataatcacctcccccaccccatgctggcttacagcaagttttcagattgaaagtttgagtcccgttcataaagccacaccaggtagcgtcctacttcttaattaatagctgccctaaaccagcaagcttgttatgaggttgtgatagcatacaaagaagacagagctgtaggatgttggggagagtgggagttgtgtctatagctttatggctgtaagtgttgagtttgttgttgttgttgtttttgtttgtttgttttttgtttttttgagatggagtcttgccctgttgcccaggctggagtgcaatggcatgatcttggttcactgcaatctccacctcccaggttcaagcgattctcctgcctcagcctcctaagtagctgggattaccggcgcatgccaccatgccacgttaattcttttatatttttag

SEQ ID NO: 131100 - DNA, 4314 bp, Homo sapiens
  Payload ID: 5601
  Gene Symbol: EIF2B2
  Gene Name: eukaryotic translation initiation factor 2B, subunit 2 beta, 39kDa
  Uniprot ID: P49770
  ENST ID: ENST00000266126
  CDS Start-End: 81-1136
cgcccgccccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaagaagactcatttcataagtttgtggctcctgaagaagtcctgccattcacagaaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccaggactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttccatagttggtttatttattgtcctactctgacagaactgcttgaaacagcagcagcagagccttttttgtgtttgcatagagggctgtagttagcgggaaaagtgtacaacatggtagtactggccagatgcagtggctcccacttgtaatcctggactttgggaggctgaggtgggaggcttgtttgaggcttgtttgaggcctggagtttgagattagcctggcaacatagcaagatcctgtctctacaaaaaaatattttaaaaaattagccagacatggtggcacatgcctgtggcctcgctatgctggaggctgaggtgggaggatcacttgagcccatgagttcaaggcttcagtgagctatcattgtaccactgcactcctgcctggatgatagagcaagactctgtctctaaaaaaataacaagtacaaatgaaagtatagtttcctttacaattcactgctcctggccccaaagtttgttcatagtctaaaacagtagttccaaaacctcgctgatcatcagaatcacctgagagtgattccgatcactcactcacacagtcttgggtttcatctcagtcctactgcatctgatctcagggttactacctgggaatctgtttaaagcttcccagaaaaggatagtctcatgtagtgtttataggactataaattggtacagccttttagagggcaatttggaagctgtatttctagaattatttgtacaagcaaaaagatttatacagagtgttcagtgtagtagttgtaatgtcatagcctaagtgtccagcaataggagaaaggttaagtattgacagttacaccgtggaacattatacatggcaatagaagtttcaaaaggatggctggaggggcagtgtctggattgaaggcatttgggctggttcactgcatttaatgtgaatttgttaccaatatttaaaaatctggagattgcacatttcaaaaattcagatttcttgcttttcttgaaaactcaaatttggcaactctgggccaacatttccaaatggcagtagttagtttgtggttgggtaacatctgatgccattggatggaacatctccagttttctgcagttcctactggatccatttaactcatttatgttatctgcctaacccctgtaggcatttgagttgtgatcctggtgttaaaagaatgggacagatttgcaaggaagtccatttgatactctgttagttaaaaacaagctggggaaaaaaaacacaacaagctgcagagcaatatgcataatacggactcatttccataaaacaacactggctgggcgcaatggctcacgcctataatcccagcactttgggaggctgaggagggcagatcacttgaggtcaggagtttgagaccagcctggtcaaaatggcgaaactaaaatactataataaaatttttagttccactaaaaatacaaaaattagccaggtgtggttgtgggtacctgtagtcccagctactcgggaggctgaacttgggaagtagaggttgcagtgagcagtgccattgggccactgcactttagcctgggcaacagtgggtgagactctgtctcacaaaaacaaaacaaaattatatgtacacgcatagggaaacagtatagaagtataataccaagcacagcaagcagagggacatcctctaattttgttgacatgtttatgcttacatattgtttccggtttttaacctaaaaagtctcccaggtgatccagattttctgccatgtttaggaactagtggtccaaagcagggcctcttgtgcagtgtctgtgtgggtggagggagcactaagaatctgcatgtttaacaaatagcctgtgggctttgaacaggtgatttgaaaccacattttggttaacactgggcagaggtaggttctgagggaaaggtctctattctttgatatctctttgagagcgatctttgccttaggtcttccagagaggggaaaaaagtaagacctcagaaagtcggcattttacactgacctaaaagctgtatgactcagaagagcctgactcactcaggctcagtctttctattatttcttaaagcatctaagaccccacgctttctcagtgaagtggcttgtagctaccaattacgagcaattgtctcctccaaaggcaccaattctaacagcaattcacttgggtacaattgtgtggtttggagtaagagcagcagtgaggcaaggaacttaaatctgttcctggctccaaaaatgctttatgatacttgtcctttgtccatcttagtctctgtgtctaaaattagcaccaacatccttcccaggcatgactgagttggatgaaggttataagggtagaagctctctttctggtcagctcttacagtgcctagaacagaactgcaggaatgcatactttttagaatctttatgaccccaattaagtaaaccctattaaggctcatcttcttatttcccctctctccgtttccctatttgaggaggggtaagtatcagaaagagagaacctgaactgaacaggaggaaacagaagttccacatcaactcactacctgtcagccttggtatcaggggtgcccacctcccacccctgccttgctggcggaaccgagaaactcggaaaaaaacaaacaaaaaaacaactgttgtagcttggagagaattaatagaactaggattccatggatgtgaaagtcttcctcaatatgctaaataaaccaagttagataaca

SEQ ID NO: 131101 - DNA, 896 bp, Homo sapiens
  Payload ID: 5601
  Gene Symbol: EIF2B2
  Gene Name: eukaryotic translation initiation factor 2B, subunit 2 beta, 39kDa
  ENST ID: ENST00000553401
  CDS Start-End: 1-603
gagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagaatcagcctttccctcccattgcagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaagaagactcatttcataagtttgtggctcctgaagaagtcctgccattcacagaag

SEQ ID NO: 131102 - DNA, 831 bp, Homo sapiens
  Payload ID: 5601
  Gene Symbol: EIF2B2
  Gene Name: eukaryotic translation initiation factor 2B, subunit 2 beta, 39kDa
  ENST ID: ENST00000556028
  CDS Start-End: 18-638
aggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaaga

SEQ ID NO: 131103 - DNA, 551 bp, Homo sapiens
  Payload ID: 5601
  Gene Symbol: EIF2B2
  Gene Name: eukaryotic translation initiation factor 2B, subunit 2 beta, 39kDa
  ENST ID: ENST00000554748
  CDS Start-End: 1-216
gagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagggcctgtcctttgtaacctgaatacaagcaaggactaagtgaagagccatttcatcagtgatagaagctatttgctttgaaaacatcaacctatttataggtctctattttttaaattgaggtgaaattcacataacatacaattaaccattttaaagtatacaatttagtgatatctagtacattcacagcattgtacaaccaccactctctagtttcaaaactttttctccactgtagaaaaacaccctgtacccattaagtaatctctccctatttgtccttctccccatctcctccaatctgctcctgtctctatggatttgcccattttgtataaaaggaatcatataata

SEQ ID NO: 131104 - DNA, 1659 bp, Homo sapiens
  Payload ID: 5602
  Gene Symbol: EIF2B3
  Gene Name: eukaryotic translation initiation factor 2B, subunit 3 gamma, 58kDa
  Uniprot ID: Q9NR50
  ENST ID: ENST00000360403
  CDS Start-End: 128-1486
attgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtg

SEQ ID NO: 131105 - DNA, 1457 bp, Homo sapiens
  Payload ID: 5602
  Gene Symbol: EIF2B3
  Gene Name: eukaryotic translation initiation factor 2B, subunit 3 gamma, 58kDa
  Uniprot ID: Q9NR50
  ENST ID: ENST00000372183
  CDS Start-End: 105-1343
cgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaagggtatgtttccccctgtacccacttgaggcaaagataatggaaaaatgccttcaaaattctgaaggaaggttaattttaacctaaaattgtatacccaggcaaagtgctaatcaagagggcaatagaataaaaacattttcagatatcaaaa

SEQ ID NO: 131106 - DNA, 892 bp, Homo sapiens
  Payload ID: 5602
  Gene Symbol: EIF2B3
  Gene Name: eukaryotic translation initiation factor 2B, subunit 3 gamma, 58kDa
  ENST ID: ENST00000439363
  CDS Start-End: 1-668
tggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgta

SEQ ID NO: 131107 - DNA, 1923 bp, Homo sapiens
  Payload ID: 5602
  Gene Symbol: EIF2B3
  Gene Name: eukaryotic translation initiation factor 2B, subunit 3 gamma, 58kDa
  Uniprot ID: Q9NR50
  ENST ID: ENST00000620860
  CDS Start-End: 240-1445
ctctccgctgagtgtgcttcccctccgtcatccatcgctcggcggtcttctcttctccatgggtctgctctgcgcgttccatcgagtttctcggccatcgcgcgcctgcgccattgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtgtatgttcatgtgtcatgtggtaaagatcatctggagcaagtgtgtgggacaggacagatacagtggcctaactcttgtgtgccaagatgtatcggtggggcagcagctgtccaatgtaaagctcctaggaaggctactttctgactggctgacccaacccagtcctgaaagtatccctcacctaaaaggacctgggagtacttcagtcccttatcctaatcagcctttctagacccataggcctagctgctggcag

SEQ ID NO: 131108 - DNA, 1082 bp, Homo sapiens
  Payload ID: 5602
  Gene Symbol: EIF2B3
  Gene Name: eukaryotic translation initiation factor 2B, subunit 3 gamma, 58kDa
  ENST ID: ENST00000480675
  CDS Start-End: 117-503
agtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagctacccaaacctctttccctgacttatcaagagagattattggttcattcattctcccaggccctggacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaaacatttgagttgctgccacctcttggctattgtgaatagtgctgcagtgaacgtgggtgtacagacatctcttcaagaccttgctttcagttcttttggatatatatttagaagtgggattactggatcatatggtagagaactatgatgtttaattttttgaggaaactacatactgtttccatggcattttcactattttacaatcccaccaacagtgcataagagccccagtttctccacaccagtacttacatggtagctggtctcagatacagaaggaaaagagaattcatttatgttatatcaaaacaaataaaacatctgggcaga

SEQ ID NO: 131109 - DNA, 1792 bp, Homo sapiens
  Payload ID: 5603
  Gene Symbol: EIF2B4
  Gene Name: eukaryotic translation initiation factor 2B, subunit 4 delta, 67kDa
  Uniprot ID: Q9UI10
  ENST ID: ENST00000347454
  CDS Start-End: 173-1744
agtgcggggcggggcctcggggcccgtcggaaattgtagtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 131110 - DNA, 1570 bp, Homo sapiens
  Payload ID: 5603
  Gene Symbol: EIF2B4
  Gene Name: eukaryotic translation initiation factor 2B, subunit 4 delta, 67kDa
  ENST ID: ENST00000405940
  CDS Start-End: 2-709
gatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataa

SEQ ID NO: 131111 - DNA, 1608 bp, Homo sapiens
  Payload ID: 5603
  Gene Symbol: EIF2B4
  Gene Name: eukaryotic translation initiation factor 2B, subunit 4 delta, 67kDa
  Uniprot ID: Q9UI10
  ENST ID: ENST00000445933
  CDS Start-End: 21-1589
ggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggtta

SEQ ID NO: 131112 - DNA, 1633 bp, Homo sapiens
  Payload ID: 5603
  Gene Symbol: EIF2B4
  Gene Name: eukaryotic translation initiation factor 2B, subunit 4 delta, 67kDa
  Uniprot ID: Q9UI10
  ENST ID: ENST00000451130
  CDS Start-End: 1-1632
atgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgac

SEQ ID NO: 131113 - DNA, 761 bp, Homo sapiens
  Payload ID: 5603
  Gene Symbol: EIF2B4
  Gene Name: eukaryotic translation initiation factor 2B, subunit 4 delta, 67kDa
  ENST ID: ENST00000417567
  CDS Start-End: 1-584
agcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggcttgtcatcatacacatattcaagcacctggcatgatcatcagagggataaaagtgtccatttcttgttcactaaggattttactccatttaggccaagtcagaacttcgagcagccattgatcgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctccc

SEQ ID NO: 131114 - DNA, 742 bp, Homo sapiens
  Payload ID: 5603
  Gene Symbol: EIF2B4
  Gene Name: eukaryotic translation initiation factor 2B, subunit 4 delta, 67kDa
  ENST ID: ENST00000418146
  CDS Start-End: 16-54
ctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcaccta

SEQ ID NO: 131115 - DNA, 1949 bp, Homo sapiens
  Payload ID: 5603
  Gene Symbol: EIF2B4
  Gene Name: eukaryotic translation initiation factor 2B, subunit 4 delta, 67kDa
  ENST ID: ENST00000493344
  CDS Start-End: 314-1948
ggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgac

SEQ ID NO: 131116 - DNA, 1754 bp, Homo sapiens
  Payload ID: 5603
  Gene Symbol: EIF2B4
  Gene Name: eukaryotic translation initiation factor 2B, subunit 4 delta, 67kDa
  ENST ID: ENST00000616081
  CDS Start-End: 144-1706
gaaattgtagtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggactcgggatccgggatgaaggcggagtccccctgggcctgggtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 131117 - DNA, 1771 bp, Homo sapiens
  Payload ID: 5603
  Gene Symbol: EIF2B4
  Gene Name: eukaryotic translation initiation factor 2B, subunit 4 delta, 67kDa
  ENST ID: ENST00000622434
  CDS Start-End: 210-896
cgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccct

SEQ ID NO: 131118 - DNA, 2655 bp, Homo sapiens
  Payload ID: 5604
  Gene Symbol: EIF2B5
  Gene Name: eukaryotic translation initiation factor 2B, subunit 5 epsilon, 82kDa
  Uniprot ID: Q13144
  ENST ID: ENST00000273783
  CDS Start-End: 123-2288
tccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgt

SEQ ID NO: 131119 - DNA, 597 bp, Homo sapiens
  Payload ID: 5604
  Gene Symbol: EIF2B5
  Gene Name: eukaryotic translation initiation factor 2B, subunit 5 epsilon, 82kDa
  ENST ID: ENST00000432982
  CDS Start-End: 1-277
agtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaag

SEQ ID NO: 131120 - DNA, 2389 bp, Homo sapiens
  Payload ID: 5604
  Gene Symbol: EIF2B5
  Gene Name: eukaryotic translation initiation factor 2B, subunit 5 epsilon, 82kDa
  ENST ID: ENST00000444495
  CDS Start-End: 11-2128
agagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacaggtggtgtgttaaaggcttgactaaacgggattcagtttttctacttttgtaagacttcaaatacaaatgttcttaagtcagaggtgcctccacccacatgatggactcacctgcagccattcagaaggaggacgggcaaaccgcacagtggcacggaaagacaaggatgatggccgcgaagtgggggcagcatccgatccacattctaaaagtagcataatcaccattactaaacactaaaaaaaggaaaataaagaggtaggagagcggggg

SEQ ID NO: 131121 - DNA, 984 bp, Homo sapiens
  Payload ID: 5604
  Gene Symbol: EIF2B5
  Gene Name: eukaryotic translation initiation factor 2B, subunit 5 epsilon, 82kDa
  ENST ID: ENST00000432569
  CDS Start-End: 22-345
tggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataaagtttggtgccagtggactttgcttttatttaatggcttcagtatggaagttacaatgataacatctttgttttcccactgagtttctaaatcttgtttgttctcaccttcaaggatataaatgagctccttgtcatctttgtattcccactgcctagctcagtcccaagcatatagtgagcacttacatgtttgttgaaatcttgaaaactagggaatcgcattgcttatggaagtccaggatgtaaagactaggacattagcatggtctccatcagacagttcctaaatgttatatggattgcagaaggggaaagctgacgtgaagcgtgttcccaggctactttgtgtaccctaggcttcagcaggattttgagttcaaattgatgtttagggacaa

SEQ ID NO: 131122 - DNA, 2005 bp, Homo sapiens
  Payload ID: 5605
  Gene Symbol: EIF2D
  Gene Name: eukaryotic translation initiation factor 2D
  Uniprot ID: P41214
  ENST ID: ENST00000271764
  CDS Start-End: 118-1872
cgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 131123 - DNA, 1633 bp, Homo sapiens
  Payload ID: 5605
  Gene Symbol: EIF2D
  Gene Name: eukaryotic translation initiation factor 2D
  Uniprot ID: P41214
  ENST ID: ENST00000367114
  CDS Start-End: 118-1500
cgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtgccccgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 131124 - DNA, 920 bp, Homo sapiens
  Payload ID: 5605
  Gene Symbol: EIF2D
  Gene Name: eukaryotic translation initiation factor 2D
  ENST ID: ENST00000437518
  CDS Start-End: 109-920
gccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctc

SEQ ID NO: 131125 - DNA, 479 bp, Homo sapiens
  Payload ID: 5605
  Gene Symbol: EIF2D
  Gene Name: eukaryotic translation initiation factor 2D
  ENST ID: ENST00000484492
  CDS Start-End: 1-199
gcttcaagaacaaatggatgagctgttacagcaatgcttcttacatgccttgaagtgccgagtcaaaaaggctgacctccctttactcaccagcactttccttggcagccacatgttctcctgctgccccgaaggacgacaactggacataaagaagtcaagctacaaaaaggaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaag

SEQ ID NO: 131126 - DNA, 750 bp, Homo sapiens
  Payload ID: 5605
  Gene Symbol: EIF2D
  Gene Name: eukaryotic translation initiation factor 2D
  ENST ID: ENST00000472709
  CDS Start-End: 1-189
gacagtcttctgaccaggtgtttggaaaaattacagcctgcctatcaagtgacccttcccggacaagagcccattgtgaagaaagggagaatctgtccaattgacatcaccctagcacaaagagcgtctaataaaaagataacaaaactgaggctgagtttaagaaacatgcctgtggtcccctgctagtaagaagctaagtaggaactggaatcaaatccatctaaggcccatgctcttctcaattcaccatgtagccaccatgggacggcatcttttgctgaaggggccggcctgccacacccataatgatcactgaaactctgtgctgcggggctgggatgagcagctgttaaaccaaagcctgtctctggaactgaaccttgattctgttgcagaccacccaagggcaagcagctctggccatctcccacttgccggagaaattaaaacgtttttgtggacctctaaagtcgtgtgtgcctgtggcacgatgcctgctgtgcctcatggagaagtgaccatactttccagctgttcagtcccagaccaccctgaaccagagtactgcagagttaattaaggatggacggtgggtaggtgagtgagtggatcccaataccccatcccaggccaactctctcctaagctctctcagttctttcaggccaatttagagagtattcctttgcaaatgatatatgccataagggattgatatgcagaatatataaactaccacaatacaaa

SEQ ID NO: 131127 - DNA, 437 bp, Homo sapiens
  Payload ID: 5605
  Gene Symbol: EIF2D
  Gene Name: eukaryotic translation initiation factor 2D
  ENST ID: ENST00000613435
  CDS Start-End: 1-220
ggtgctcgagaaactggtagggggagcagatttgatgctgcctggactggtgatgccccctgctggtctgcctcagccccgaaggacgacaactggacataaagaagtcaagctacaaaaaggaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtaatttt

SEQ ID NO: 131128 - DNA, 7540 bp, Homo sapiens
  Payload ID: 5606
  Gene Symbol: EIF3F
  Gene Name: Eukaryotic translation initiation factor 3 subunit F
  ENST ID: ENST00000626223
  CDS Start-End: 627-1700
aaatcgcttctgggtgcagccacaggagtggggttgttggtccaggtggagccatggttgagggaaaaactaaaacatgacagagtttattcatcaatgggaacttttatatactgttagaaggcatgtaaattggaacagcctctttggaaaacaagtctgcattatcttcctcgagcttctgggctcaaacgatccttccgcctcggtctcccgaagtgctgagattacaggcgtgagccaccgcgcctggccttaaaatcctttttaaaggcactttgacatccattatctcatttaagtctaaaacacgaatttcgacctccgcgctgctttctggttccacctggcggcagctgcacaaagtgtttctcttcgaacgccgtcccaagttttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggccttgtaggctagagtacttgcctgtgtaacttcagacatccatttcctctggtatcctggagttccgcctcgccactgtgtgtcttagaaataagtcattattcaagaactcaggaaattatacgttggagtgaaaaggtgagtgaaggcaatggggaatcaaaaaggcctggatcctagttctgaggtatgtgtagccttaggaaagataaattataagagtcataagatatggatcataaacatacatagtccattagggtattatgaggattccatgaattaataaatgtcaggttaatcaacacttgtggagaatatcacctggtatgtagtaagcacagataagtggtagatactatgatgcctaaaggtgaatagtttgaaagtaataagcaacatgaaccccagcctggaactcagttctgagatatgtacctcaggaaatataagttatgggagtcataaagtgtggatagtaatgatagataatttcttacaggtagggaaatgtaaacagatcttatcggcaaaatgataatgacaggccaaattgttaaaggtaggttaaaagtagacagcatggtgggaaggttaatcagagtcaaaatgtttcagtgttcttacatttttgggagtagccagttaatatcaacttagtctttttaagtatgcatgataaaattccgaggttaattgctagaagtatatataatctctcaatgaatagtgatgagagatggtgggataatagggaagaaacaaaattttaaatttgagaaataagcatagaaaaggtggataaaacaaaagatggcaaaacaagtccaaatagatcagtaattacaataaatgtataagtattaaactagcccaaggaaaaattgaatattaaaacaaaccccaatcatatgctgtttacaggagacacatctaaaacaaggacataaagttgtcctgcagctgtgagtaacaatataggtgaatgttaataataatgttgaatgaaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactgaattagagagtactgaaccattattcccaagggaaatacagggttgggttcctatgaacctctgggcacagtttcatcaacccatcagtacataaacttgttacatgtgtttctgtttgaagacaccttagtatatatggttgacccattaacactgaacttagcccacgacacttattcctgaatgaagcttacctcagtttctccaggcggcacatcacagtcttcttgcacttaggaacacttggcactgtgcgtgggggtcactttaagcagcaaaatccacaaaaatgcaaaagacatggcactaaatagactgaaaaggatacttgtttataagaactgaaacaagaaggccttgttccacctcagctgggaacatggagagcaggcaattcaaattttttcacatgctgcatgtccgcaaatggctgcaaaagcccagcaagtactgatactggagttagaaataaattttagcaagaggtaaattcacacatacggagtctgcaaaaaatgagaattgactattatgtgtgtgtatattatatatatgataaaaaacaaaagaatgataaaaattcccaataatgtttactttggtggtgagaagaggatggcaagtaaaataagtctgtattgttatcagcaattatctagtttgaggttggacagtggtttcatcataggtattgattatattataaatagcccaacctgaactcatgaccatagtgtggtgttattacttagcgttattctagacttattagccattgtatttaaacaagaggaaatagagacattgaagataaagtggagccaggcacagtggctcatgcctgtaatcccagcactttggcaggctgagatgggttaatcaagaccagaagttcaagaccagcgtggccaacatggcaaaaccccgtctctactaaaaaaaaacaaaaaatacaaaaattagccaggcgtggtggcacgcacctgtagtcccagctacttgggaagctgaggcaggagaatctcgaacccaggaggtaggggttgcagtgagctgagatcgcaccactgcaccccagcctgggtgacagcaagatcctttctcaagaaaaaaagtgaaaaggaggagggtttttaaaaaattagtactacccagttgatacggtggaagaaaacttgaaaatgctaatgagaaacatgagatgtaatcacttgaaggcatatcatgttcttgaataagaagactcaacattattttaacaggtgttaattttccctgttaaactacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtggaaaacagtttgtagagcttcctcaataaaaacacatatgatccagcaatcccactactgggtatatatccaaaggaaatgaaatcagtatgttgaagagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgatgaaaccccgtctctacaaaagatacaaaaattagccaggcatcttggagggcgcctgtaatcccacctactcgggctgaagtgagaatggcttgaacccaggaagtggagatttcagtgagctgagattccgccactgcagtccagcctgagcgacaagagtgagaagagtgagacttcatctcaaaaaaaaaaaaggtacatctacacaatggaatattattaaccttaaaagaaggaaataactgatttacaacaacatggatggacctggaggacactatgctagtgaaataagccatgatctcacttggatatggaatcacaaaattgaactcacaagcagagtgtagaaaggtggtttcatggactggagggaggggataaatggggagatgttggtcaagggtacaaagtttcagttaaacaggagtagtacgttccggagacctgttgtgcagcagggtgactagttaatgtatacttgaaaattgctaggagtagatctcaccaggagaaatgaatatgtgaggtgatggatgtaactagcttgattgtggtaatcaatttcgcaatgtgtacatatatcaaaacatcacattgtacaaaatacatacagtttttgtcaatttaaagatatcagaattctagaatatgataaagttgtgttttcaagcaagtaaagatagattacttaagagcgaatgagtggtaatttggaaacaatgttggattcctacttcgttacctgcaccaaaataagttgctcatggaataaaaacttgtctgaaaaaaaaaccataaatatgagggaaaaaacacagcaatgtgtttttaatgatttatgagtgaggaagaactttctaagaactgagaatccaggagttattttaaaagactgacaaatttagcaacatttttaaaatctgagtgtcaaattacacacatacacaaatagtcaatacaaatataaaactgggaaaatatttgcagttcatatcaaaaaaagggctaatattcttgtcccagaattcctacagttttttaaggccagtaatttgatacattagtgtgtaaaggatatgaccagacagctcacacacagacacacaaatgtgaaaagatgcttgatctcactgataaagcataaattaaaacgatgtcatttttaaaaatcagattcgcaaattttaaaagttgctaacactggaatggccagagtaagaggaaacgtgacacaggcacagattgctggtagacatataagttggtacagccctctctatgtaattttgtgtttgtcaaaattacaaatatgcatgcccttaacccaggaattccactcctcattatatatcctacaaataaactggtctcgttatgacacaatgtaatgaatacatagataagtactgaaatacttggttatcatagcgtaaagatggtaatcaacccaaatgactattaccagaatagaaattaaacaaagtatgatatatccataaaacacaatactatgcagctgttaagcagaatgagacagtcctctatatatcaatatggataaagagtaagtgaaaaaagccaggagagaatgttgtctataatatgctgttgttgtgtacgggaaaataaataatataaatacctagaatatttgtgaaggtacagccaagaaactactatcactgattgtcttaaggtactagatggggcacaggacaggacgaaagatttacttcttattgtttcttctgtataacttttgaattttatgctgttaatgtaatttttcaaaaaaatatataaaaatataaaaacatgaaaaacatgaaacaa

SEQ ID NO: 131129 - DNA, 1254 bp, Homo sapiens
  Payload ID: 5606
  Gene Symbol: EIF3F
  Gene Name: Eukaryotic translation initiation factor 3 subunit F
  ENST ID: ENST00000628056
  CDS Start-End: 34-1107
atttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatt

SEQ ID NO: 131130 - DNA, 1072 bp, Homo sapiens
  Payload ID: 5606
  Gene Symbol: EIF3F
  Gene Name: Eukaryotic translation initiation factor 3 subunit F
  ENST ID: ENST00000630137
  CDS Start-End: 17-391
cttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcaga

SEQ ID NO: 131131 - DNA, 485 bp, Homo sapiens
  Payload ID: 5606
  Gene Symbol: EIF3F
  Gene Name: Eukaryotic translation initiation factor 3 subunit F
  ENST ID: ENST00000629098
  CDS Start-End: 1-303
aacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaac

SEQ ID NO: 131132 - DNA, 6646 bp, Homo sapiens
  Payload ID: 5607
  Gene Symbol: EIF3A
  Gene Name: eukaryotic translation initiation factor 3, subunit A
  Uniprot ID: Q14152
  ENST ID: ENST00000369144
  CDS Start-End: 129-4277
ggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgacccttcaggtattgagtaacacctttatcttggtatagaactgatactttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgtttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattttggtttaataaatcaaatctatgacaaaa

SEQ ID NO: 131133 - DNA, 4495 bp, Homo sapiens
  Payload ID: 5607
  Gene Symbol: EIF3A
  Gene Name: eukaryotic translation initiation factor 3, subunit A
  Uniprot ID: Q14152
  ENST ID: ENST00000541549
  CDS Start-End: 148-4296
ctccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttg

SEQ ID NO: 131134 - DNA, 3055 bp, Homo sapiens
  Payload ID: 5608
  Gene Symbol: EIF3B
  Gene Name: eukaryotic translation initiation factor 3, subunit B
  Uniprot ID: P55884
  ENST ID: ENST00000360876
  CDS Start-End: 57-2501
gggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaa

SEQ ID NO: 131135 - DNA, 2966 bp, Homo sapiens
  Payload ID: 5608
  Gene Symbol: EIF3B
  Gene Name: eukaryotic translation initiation factor 3, subunit B
  Uniprot ID: P55884
  ENST ID: ENST00000397011
  CDS Start-End: 41-2485
cggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaa

SEQ ID NO: 131136 - DNA, 962 bp, Homo sapiens
  Payload ID: 5608
  Gene Symbol: EIF3B
  Gene Name: eukaryotic translation initiation factor 3, subunit B
  ENST ID: ENST00000413917
  CDS Start-End: 56-962
ggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgtt

SEQ ID NO: 131137 - DNA, 1074 bp, Homo sapiens
  Payload ID: 5608
  Gene Symbol: EIF3B
  Gene Name: eukaryotic translation initiation factor 3, subunit B
  ENST ID: ENST00000431643
  CDS Start-End: 615-1074
gtgacccgcgctgtcccgcgctgaaggcggcggcctcggatggactgaaccactgtgaaagcccgaatggggggaaacaggcagtgacggccgctagggaaggactggggggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccatt

SEQ ID NO: 131138 - DNA, 3145 bp, Homo sapiens
  Payload ID: 5609
  Gene Symbol: EIF3C
  Gene Name: eukaryotic translation initiation factor 3, subunit C
  Uniprot ID: Q99613
  ENST ID: ENST00000331666
  CDS Start-End: 187-2928
aggcttgtccccgcccccttatggcgcgaaggccactgggagttgtagtctcccagtgtagttagtcggcgcttcccggaagtgacgcgaggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaa

SEQ ID NO: 131139 - DNA, 3137 bp, Homo sapiens
  Payload ID: 5609
  Gene Symbol: EIF3C
  Gene Name: eukaryotic translation initiation factor 3, subunit C
  Uniprot ID: Q99613
  ENST ID: ENST00000395587
  CDS Start-End: 182-2923
agtgtagttagtcggcgcttcccggaagtgacgcgaggacccgccttctctctcggcgtttccgctgtcagggccctgcggtgtgactcgcgggctcagctggttggtattttttgggcctcgtgcttcgtggtgggagacccaggtcgaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctc

SEQ ID NO: 131140 - DNA, 572 bp, Homo sapiens
  Payload ID: 5609
  Gene Symbol: EIF3C
  Gene Name: eukaryotic translation initiation factor 3, subunit C
  ENST ID: ENST00000568426
  CDS Start-End: 175-572
attgagactttctccttgctgttggcctctcatactttgggaaatgttgctaagatctagtttaggccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagc

SEQ ID NO: 131141 - DNA, 581 bp, Homo sapiens
  Payload ID: 5609
  Gene Symbol: EIF3C
  Gene Name: eukaryotic translation initiation factor 3, subunit C
  ENST ID: ENST00000569690
  CDS Start-End: 136-581
tctctctcggcgtttccgctgtcagggccctgcggtgtgactcgcgggctcagctggttggtattttttgggcctcgtgcttcgtggtgggagacccaggtcgaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaa

SEQ ID NO: 131142 - DNA, 2870 bp, Homo sapiens
  Payload ID: 5609
  Gene Symbol: EIF3C
  Gene Name: eukaryotic translation initiation factor 3, subunit C
  Uniprot ID: Q99613
  ENST ID: ENST00000564243
  CDS Start-End: 76-2787
gtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtt

SEQ ID NO: 131143 - DNA, 516 bp, Homo sapiens
  Payload ID: 5609
  Gene Symbol: EIF3C
  Gene Name: eukaryotic translation initiation factor 3, subunit C
  ENST ID: ENST00000563139
  CDS Start-End: 278-516
ttcttaactggccttaagtctacagcctctacctgtctcctctcattttaccgccgagaagtccttagtgacttctcactgctcacagaaggaaatgcaaaatgcttgattggtatctgggagccccctgatgcgactctgaagtctggtcacctgctgtgtacgcaggccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccg

SEQ ID NO: 131144 - DNA, 2986 bp, Homo sapiens
  Payload ID: 5609
  Gene Symbol: EIF3C
  Gene Name: eukaryotic translation initiation factor 3, subunit C
  Uniprot ID: Q99613
  ENST ID: ENST00000566866
  CDS Start-End: 161-2902
tttttgggcctcgtgcttcgtggtgggagacccaggtcgaggtccgggtggggccggtgaggggttgggcgtcgggaggtgttggctcgggcctcttcgcgtggccggtgacgccttggctcccccgcaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttg

SEQ ID NO: 131145 - DNA, 3128 bp, Homo sapiens
  Payload ID: 5609
  Gene Symbol: EIF3C
  Gene Name: eukaryotic translation initiation factor 3, subunit C
  Uniprot ID: Q99613
  ENST ID: ENST00000566501
  CDS Start-End: 302-3043
gtggcaggcagccctgcaccggacacacagtggcattcaacttcctgcctgccagccccagtgtgtggttcccagcctgacaaccttggcaccccagcaccccagcaggaggggtttctgcttgtggtcccctggccaccagcctcggccagctggttgtggaccagccgtgacctggggcaacccagccaacctcaccgtccaatgggctgcagccacctctctccagtgaggtctgagacccagccttaacgaggctacccccttccaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgt

SEQ ID NO: 131146 - DNA, 3085 bp, Homo sapiens
  Payload ID: 5610
  Gene Symbol: EIF3CL
  Gene Name: eukaryotic translation initiation factor 3, subunit C-like
  Uniprot ID: B5ME19
  ENST ID: ENST00000380876
  CDS Start-End: 124-2868
agtcggcgcttcccggaagtgacgcgaggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaa

SEQ ID NO: 131147 - DNA, 3053 bp, Homo sapiens
  Payload ID: 5610
  Gene Symbol: EIF3CL
  Gene Name: eukaryotic translation initiation factor 3, subunit C-like
  Uniprot ID: B5ME19
  ENST ID: ENST00000398944
  CDS Start-End: 90-2834
ctctctcggcgtttccgctgtcagggccctgcggtgtgactcgcgggctcagctggttggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaaga

SEQ ID NO: 131148 - DNA, 2155 bp, Homo sapiens
  Payload ID: 5611
  Gene Symbol: EIF3D
  Gene Name: eukaryotic translation initiation factor 3, subunit D
  Uniprot ID: O15371
  ENST ID: ENST00000216190
  CDS Start-End: 372-2018
gagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctca

SEQ ID NO: 131149 - DNA, 581 bp, Homo sapiens
  Payload ID: 5611
  Gene Symbol: EIF3D
  Gene Name: eukaryotic translation initiation factor 3, subunit D
  ENST ID: ENST00000402116
  CDS Start-End: 211-581
aggaatccactttcgggggccccgcgtcccgcacgctactgaacgcgggacacgaccttgtgggtgaggtccttggccctcggccctgctcagtgcccatgagctgggtgaatttgattgtcacttaactcacctgggttaagacggaggggtaacaacaaagtctttctgaagtggccgaaaactccctgactttttgaattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaa

SEQ ID NO: 131150 - DNA, 1851 bp, Homo sapiens
  Payload ID: 5611
  Gene Symbol: EIF3D
  Gene Name: eukaryotic translation initiation factor 3, subunit D
  Uniprot ID: O15371
  ENST ID: ENST00000405442
  CDS Start-End: 117-1763
cgggacacgaccttgtgggtgaggtccttggccctcggccctgctcagtgcccatgagctgggtgaatttgattgtcacttaactcacctgggttaagacggagggattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctct

SEQ ID NO: 131151 - DNA, 996 bp, Homo sapiens
  Payload ID: 5611
  Gene Symbol: EIF3D
  Gene Name: eukaryotic translation initiation factor 3, subunit D
  ENST ID: ENST00000455547
  CDS Start-End: 188-996
ctcttttcctggtttctcaagagtgctgctgctaacgcggtccccggcacgcaccatctgttgccatcccggccggccgaggccattgcagatggaaaagactaaggtggctggacgtggtggctcacgcctgtaatcccagcactttgggaggtcgaggcgggaggatcatttgagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtcca

SEQ ID NO: 131152 - DNA, 883 bp, Homo sapiens
  Payload ID: 5611
  Gene Symbol: EIF3D
  Gene Name: eukaryotic translation initiation factor 3, subunit D
  ENST ID: ENST00000458572
  CDS Start-End: 1-316
ctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgcgctgcgcacattgtcagtgactctttgttgcatggtgagtgaccatgccacgcttttgcagacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagcc

SEQ ID NO: 131153 - DNA, 729 bp, Homo sapiens
  Payload ID: 5611
  Gene Symbol: EIF3D
  Gene Name: eukaryotic translation initiation factor 3, subunit D
  ENST ID: ENST00000457241
  CDS Start-End: 209-729
aggtgagcggcgtgtttcataggttcctgcggccctccggagccggttcggactaggtccagccttcggggggcctcccggaagagacctctcttagtcccttcctgctgttgccgtccctccgctgggcggggcaggaatccactttcgggggccccgcgtcccgcacgctactgaacgcgggacacgaccttgtggattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaat

SEQ ID NO: 131154 - DNA, 452 bp, Homo sapiens
  Payload ID: 5611
  Gene Symbol: EIF3D
  Gene Name: eukaryotic translation initiation factor 3, subunit D
  ENST ID: ENST00000478547
  CDS Start-End: 1-150
atgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagctggtgactgaaggaaatacctgcccagccctgtgagcatctgaaaggcttaacttcggaatggaagtgttgaaaactcacgcacagtccagcagaggttcagaaaggaaagtgaacatcatatcacacaacctggctcatttctcttacattttttgtgtctttcagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtcttt

SEQ ID NO: 131155 - DNA, 1543 bp, Homo sapiens
  Payload ID: 5612
  Gene Symbol: EIF3E
  Gene Name: eukaryotic translation initiation factor 3, subunit E
  Uniprot ID: P60228
  ENST ID: ENST00000220849
  CDS Start-End: 64-1401
tgttcgtttgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 131156 - DNA, 611 bp, Homo sapiens
  Payload ID: 5612
  Gene Symbol: EIF3E
  Gene Name: eukaryotic translation initiation factor 3, subunit E
  ENST ID: ENST00000522352
  CDS Start-End: 1-469
cttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 131157 - DNA, 1324 bp, Homo sapiens
  Payload ID: 5612
  Gene Symbol: EIF3E
  Gene Name: eukaryotic translation initiation factor 3, subunit E
  ENST ID: ENST00000519030
  CDS Start-End: 161-1219
cggagtacgacttgactactcgcatcgcgcactttttggatcggcatctagtctttccgcttcttgaatttctctctgtaaaggagctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtat

SEQ ID NO: 131158 - DNA, 687 bp, Homo sapiens
  Payload ID: 5612
  Gene Symbol: EIF3E
  Gene Name: eukaryotic translation initiation factor 3, subunit E
  ENST ID: ENST00000518100
  CDS Start-End: 15-152
ttttctttggcaagatggcggagtacgacttgactactcgcatcgcgcactttttggatcggcatctagtctttccgcttcttgaatttctctctgtaaaggaggttgtttcagcaatgtggatggagaagcatataggagtttattactgattacctggatgtggagaagtgacagctatatgtgctttacaggaaagatggcgtgggttttatttatacacagccttgcctagaaagggtaagagatggtttgtagggacacataaaaaataaggtcatgtaaatcagaagtaggtgggaatgtctacagtaattctcttcattttaaaatttttagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcagga

SEQ ID NO: 131159 - DNA, 223 bp, Homo sapiens
  Payload ID: 5612
  Gene Symbol: EIF3E
  Gene Name: eukaryotic translation initiation factor 3, subunit E
  ENST ID: ENST00000521297
  CDS Start-End: 1-223
actttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgggatggtaggatgctctttgactacctggcggacaagcatggttttaggcag

SEQ ID NO: 131160 - DNA, 746 bp, Homo sapiens
  Payload ID: 5612
  Gene Symbol: EIF3E
  Gene Name: eukaryotic translation initiation factor 3, subunit E
  ENST ID: ENST00000521440
  CDS Start-End: 1-515
cggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctgatggagtcttgctatgttgcccaggctgatctcaaactcctggcctgaagtgatcctccctcctcagcctttcaatgctttgggatttacagccatgagcctctgcaccctgcctgtctaagatttctctagttaatcctagaagttggaaaaagaccttaaaacagagactttttgtcttccaaccttggaagagtttgtttctttttgcctttactttctggtgcttttttcttcacttgtagctccacatgttgcaaaataaagtctcatggctgc

SEQ ID NO: 131161 - DNA, 575 bp, Homo sapiens
  Payload ID: 5612
  Gene Symbol: EIF3E
  Gene Name: eukaryotic translation initiation factor 3, subunit E
  ENST ID: ENST00000522887
  CDS Start-End: 16-186
cttttctttggcaagatggcggagtacgacttgactactcgcatcgcgcactttttggatcggcatctagtctttccgcttcttgaatttctctctgtaaaggaggaaagatggcgtgggttttatttatacacagccttgcctagaaagggtaagagatggtttgtagggacacataaaaaataaggtcatgtaaatcagaagtaggtgggaatgtctacagtaattctcttcattttaaaatttttagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagt

SEQ ID NO: 131162 - DNA, 558 bp, Homo sapiens
  Payload ID: 5612
  Gene Symbol: EIF3E
  Gene Name: eukaryotic translation initiation factor 3, subunit E
  ENST ID: ENST00000518345
  CDS Start-End: 334-558
cttttctttggcaagatggcggagtacgacttgactactcgcatcgcgcactttttggatcggcatctagtctttccgcttcttgaatttctctctgtaaaggagtagagacagggtttcaccgtgttagccaggatggtctcgatctcctgacctcgtgatccgcctgcctcggcctcccaaagtgctgggattacaggcgtgagccactgcgcctggcgacatccttaaaccttcatcttgacccctgttagtcactactcacaccccctaaagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttagg

SEQ ID NO: 131163 - DNA, 841 bp, Homo sapiens
  Payload ID: 5612
  Gene Symbol: EIF3E
  Gene Name: eukaryotic translation initiation factor 3, subunit E
  ENST ID: ENST00000522445
  CDS Start-End: 17-244
ccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgtgctcttctgcatttttaattagctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttc

SEQ ID NO: 131164 - DNA, 697 bp, Homo sapiens
  Payload ID: 5612
  Gene Symbol: EIF3E
  Gene Name: eukaryotic translation initiation factor 3, subunit E
  ENST ID: ENST00000519627
  CDS Start-End: 18-697
cccttttctttggcaagatggcggagtacgacttgactactcgcatcgcgcactttttggatcggcatctagtctttccgcttcttgaatttctctctgtaaaggaggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaa

SEQ ID NO: 131165 - DNA, 1254 bp, Homo sapiens; identical to SEQ ID NO: 131129
  Payload ID: 5613
  Gene Symbol: EIF3F
  Gene Name: eukaryotic translation initiation factor 3, subunit F
  Uniprot ID: O00303
  ENST ID: ENST00000309828
  CDS Start-End: 34-1107

SEQ ID NO: 131166 - DNA, 7540 bp, Homo sapiens; identical to SEQ ID NO: 131128
  Payload ID: 5613
  Gene Symbol: EIF3F
  Gene Name: eukaryotic translation initiation factor 3, subunit F
  Uniprot ID: O00303
  ENST ID: ENST00000533626
  CDS Start-End: 627-1700

SEQ ID NO: 131167 - DNA, 1072 bp, Homo sapiens; identical to SEQ ID NO: 131130
  Payload ID: 5613
  Gene Symbol: EIF3F
  Gene Name: eukaryotic translation initiation factor 3, subunit F
  ENST ID: ENST00000531329
  CDS Start-End: 17-391

SEQ ID NO: 131168 - DNA, 485 bp, Homo sapiens; identical to SEQ ID NO: 131131
  Payload ID: 5613
  Gene Symbol: EIF3F
  Gene Name: eukaryotic translation initiation factor 3, subunit F
  ENST ID: ENST00000531572
  CDS Start-End: 1-303

SEQ ID NO: 131169 - DNA, 1103 bp, Homo sapiens
  Payload ID: 5614
  Gene Symbol: EIF3G
  Gene Name: eukaryotic translation initiation factor 3, subunit G
  Uniprot ID: O75821
  ENST ID: ENST00000253108
  CDS Start-End: 44-1006
gctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctct

SEQ ID NO: 131170 - DNA, 828 bp, Homo sapiens
  Payload ID: 5614
  Gene Symbol: EIF3G
  Gene Name: eukaryotic translation initiation factor 3, subunit G
  ENST ID: ENST00000588709
  CDS Start-End: 41-828
ctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaaggtgaggattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcc

SEQ ID NO: 131171 - DNA, 636 bp, Homo sapiens
  Payload ID: 5614
  Gene Symbol: EIF3G
  Gene Name: eukaryotic translation initiation factor 3, subunit G
  ENST ID: ENST00000593095
  CDS Start-End: 60-509
gttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagagtgttgctctgtcccccaggctgaagtgcagtggcacgatctcgactcactgcaacctccgcctcctgggttcaagtgattctcctgcctcagcctcccgagtagctggggttacagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaag

SEQ ID NO: 131172 - DNA, 873 bp, Homo sapiens
  Payload ID: 5614
  Gene Symbol: EIF3G
  Gene Name: eukaryotic translation initiation factor 3, subunit G
  ENST ID: ENST00000589454
  CDS Start-End: 6-873
ttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactgagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattg

SEQ ID NO: 131173 - DNA, 590 bp, Homo sapiens
  Payload ID: 5614
  Gene Symbol: EIF3G
  Gene Name: eukaryotic translation initiation factor 3, subunit G
  ENST ID: ENST00000593066
  CDS Start-End: 11-169
actttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggaggtgagtgaggactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgg

SEQ ID NO: 131174 - DNA, 453 bp, Homo sapiens
  Payload ID: 5614
  Gene Symbol: EIF3G
  Gene Name: eukaryotic translation initiation factor 3, subunit G
  ENST ID: ENST00000593054
  CDS Start-End: 1-357
actggcgagaaggagaagctgccgggagagctagagccggtgcaggccacgcagaacaagacagggaagtatgtgccgccgagcctgcgcgacggggccagccgccgcggggagtccatgcagcccaaccgcagagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctc

SEQ ID NO: 131175 - DNA, 709 bp, Homo sapiens
  Payload ID: 5614
  Gene Symbol: EIF3G
  Gene Name: eukaryotic translation initiation factor 3, subunit G
  ENST ID: ENST00000587146
  CDS Start-End: 28-709
tgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcg

SEQ ID NO: 131176 - DNA, 555 bp, Homo sapiens
  Payload ID: 5614
  Gene Symbol: EIF3G
  Gene Name: eukaryotic translation initiation factor 3, subunit G
  ENST ID: ENST00000587993
  CDS Start-End: 20-142
gtggagaatactttttgcgatgcctactggagactttgattcgaagcccagttgggccgaccaggtggaggaggagggggaggacggcgtcatcccaaaagcccttccatcgcagctggggagctcctgcccctggagctgactcctccttcctacgctgccttttgcagacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaaggg

SEQ ID NO: 131177 - DNA, 2041 bp, Homo sapiens
  Payload ID: 5615
  Gene Symbol: EIF3H
  Gene Name: eukaryotic translation initiation factor 3, subunit H
  ENST ID: ENST00000276682
  CDS Start-End: 768-1868
aggcgcgtagcaagagcttctctgaaagactggcagtatagtagtagtcagtgataatattgagccttaatatgttccagacactgtcctaagtgatttaccttacattattcccctgaatgtttataattcccaagtgaaagaaggaaatgatatattggatagctatgagtggggaggtttgtactggctgctttcccataaagaaattaagcacgttcacgaagggcacgtagtttgttagtgtctggaacccagttttcgtgcctgaagttcaaatgttcttgctacaccaccatagaaactaacgtcactcaggaaccatttgtcagggcaaagggtgccaccattttgcatttcctcctgccttaggaccatcctaaatcactcgcatggagtgttttggaagaactctcaagagcttcgtttgcctagagtcagaattcctaaccttgagtcctggttttgccacaaacccaagccgtttgatcttgggcaactcccgaagaaagctgggttcaacttcctcactgtcaaactggttgtaggtctagataagtttcaagtactctttttatgtgcatggtctctgacataggaagactacatactgggccagtaacaggaaggcacaaagctgactggaggtttaaaaattacttggtcaatttgattaatgaggagaatgaatcagaaaatttcaagttctcccgtggctaactgtcgagtatccacttcaagatcattccatcggaaagaggtcgaaaatgtacagtaggcatgcacaaaggataccgcctggaaagaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttg

SEQ ID NO: 131178 - DNA, 562 bp, Homo sapiens
  Payload ID: 5615
  Gene Symbol: EIF3H
  Gene Name: eukaryotic translation initiation factor 3, subunit H
  ENST ID: ENST00000520813
  CDS Start-End: 271-562
acttaactgtcaactccacgtgggcggggcgttttgcacctcctgagctcgcaatgaaggtctgtgagcaacggcctcgcctctacaacacccgacggaccctctgtgcctcctccccagccccccgggcccaccttgtggtgcacagctgcgtctcccccatgaggtagcggggcagctgctcccgcagctggatgcggccccgcagcgccgcctgacagaaggtgccgtccagcaggatctgatcattccatcggaaagaggtcgaaaatgtacagtaggcatgcacaaaggataccgcctggaaagaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctt

SEQ ID NO: 131179 - DNA, 843 bp, Homo sapiens
  Payload ID: 5615
  Gene Symbol: EIF3H
  Gene Name: eukaryotic translation initiation factor 3, subunit H
  ENST ID: ENST00000518949
  CDS Start-End: 112-843
aggaaggtaccggctctactgccacctcttccagctccaccgccggcgcagcagggaaaggcaaaggcaaaggcggctcgggagattcagccgtgaagcaagtgcagatagatggccttgcccagtatttcctttggggtgatctgtcaacccctggaaaaagggacaagcacacacaggagaagaggcacaggtttgggagggaagggaagcagaatttggttggacactaagagagtgagattcaccagggacagctgggtggtgatggaggcctctcaggagagagatcccagctggagagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcag

SEQ ID NO: 131180 - DNA, 731 bp, Homo sapiens
  Payload ID: 5615
  Gene Symbol: EIF3H
  Gene Name: eukaryotic translation initiation factor 3, subunit H
  ENST ID: ENST00000518995
  CDS Start-End: 26-731
tctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttttctctggtcaggtatcctctcagaagcccttcctggatccccctaaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaa

SEQ ID NO: 131181 - DNA, 518 bp, Homo sapiens
  Payload ID: 5615
  Gene Symbol: EIF3H
  Gene Name: eukaryotic translation initiation factor 3, subunit H
  ENST ID: ENST00000522453
  CDS Start-End: 9-518
ttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaaggttcattcatagtgcagcatacatcagaacttcgttccttgttattgctgagtagtattccattaaatgtattccaatatcagatggaaatgatgcggagccttcgccatgtaaacattgatcatcttcacgtgggctggtatcagtccacatactatggctcattcgttacccgggcactcctggactctcagtttagttaccagcatgccattgaagaa

SEQ ID NO: 131182 - DNA, 635 bp, Homo sapiens
  Payload ID: 5615
  Gene Symbol: EIF3H
  Gene Name: eukaryotic translation initiation factor 3, subunit H
  ENST ID: ENST00000522800
  CDS Start-End: 33-203
acgtttctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttggaaatgccttcaagtacgtagatagaaaatattgctgatgattttaagaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccct

SEQ ID NO: 131183 - DNA, 3959 bp, Homo sapiens
  Payload ID: 5615
  Gene Symbol: EIF3H
  Gene Name: eukaryotic translation initiation factor 3, subunit H
  Uniprot ID: O15372
  ENST ID: ENST00000521861
  CDS Start-End: 25-1083
ctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgattttagatgtattttctctggcttacttttgtttgcttatacttgtttatttctaaaagctaaaacaagccctgaccggaagtttcaccaggcagaaacctataggctccaccacttttgctgcctctcaggtgccacctttcaacccacttctcccaactacttatcccagctcctgaccccgaggccctggcatctactgtgaatattttttttttgaatttttatacttcgctgctcccaaatgagcaccccgagagaagtccaggcttcatgtacttgcccaggaattccttgtccccggacccggaatcacttggcctaattccggtcagtctgccttttcatttctgcaggtgatggtcaaccagtccccgtactcataggccatgggacacaagattattattatcatcattatttttaaagacagagtctcactttgttgcccaggctggagtgtagtggcacaatctcagctcgctgcaacctccaccttctgagttcaagcgattctcccacctcagcctcccaagtagctgggactacaggcgtgtgccatcacgcctggctaatttttgtatttttagtagagatggggtttcaccatgttggccaggctggtctgcatctcctgacctcaagtgattcacctgcttctgtctcccaaagtgctgggaatacaggcatgagccaccactcctggacaggccacagaaattttaaagaaaagaatcatgccaccacaagtaaacttcattttgtttatattatttaggacttcacatttgtcttccgaaaccatgaagtataattctgctaacagcaagtgttgtgaatgaggaattaggaattaggagaatggtagtacattgggaaaaacatattttagtaatttttatattttaaagataatcacagattttgctgtttgtgcatcaccaaaatcagtgagatctgccagctggtgggggtgtgcctatgagaatttttgattatgatcccctaggagggttatcaaaaaaggagatgggtgaaagatcaggagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagcccttttacctgtattgccaaattgccttcaaaagtttctgctgttttgccctcctacccatagtgataaccttaaattggagtcaacacaaatttgagtgtgactgtgttagacagaagggatatattaacaggtaaaactggccatggcccctgcccttgtggagtatatgctctgttggttcatttcctctgcattctaattttctagacttgggatcttattgtggagttaaacaaagcacccttaaagtagcaagcgagcaaaataaaagcaaggaaaatcagttggaacataacttatgtattttttaggattaagagtaatttaactgagtcaattcaatatgtttttaaaggtgtgattcttaaattctttatgattgtttagatttctatatcttggtaacatgaatacacacttaatgaaagatttcagtaatttttgatttgggaattaatcatagtgggaaaaactgtttaggaaaacatgtcagtggaaattaactcgccacagtatgtagtgttagggaatagcttctgttcggcatttgatttgagtgctgtattctgacatttttcaggaacaaatacatgtgattcatcttctataaatatttgcagtttcttcaagttgaaatgagaaaagctcgtaaattgagcaccaggtctaataaatcattcacttacccaagaacagaaagacaggaaaagctagcatgttaatctaatgaaaaaatcgaatgttaaaaaaccaagaaagtagaagatatttgacattaactttctaatcattgataataatctaataatcataacattattcttaaaacctgaaagaatggattcctgctcccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaaccaaa

SEQ ID NO: 131184 - DNA, 488 bp, Homo sapiens
  Payload ID: 5615
  Gene Symbol: EIF3H
  Gene Name: eukaryotic translation initiation factor 3, subunit H
  ENST ID: ENST00000519046
  CDS Start-End: 27-167
ctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttttttcatagggctgatggcttgttcttcagttctctggtcaggtatcctctcagaagcccttcctggatccccctaaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattc

SEQ ID NO: 131185 - DNA, 1265 bp, Homo sapiens
  Payload ID: 5615
  Gene Symbol: EIF3H
  Gene Name: eukaryotic translation initiation factor 3, subunit H
  ENST ID: ENST00000611080
  CDS Start-End: 27-1076
ctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtaataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttg

SEQ ID NO: 131186 - DNA, 564 bp, Homo sapiens
  Payload ID: 5616
  Gene Symbol: EIF3I
  Gene Name: eukaryotic translation initiation factor 3, subunit I
  ENST ID: ENST00000355082
  CDS Start-End: 190-564
tgaacccgctgcaggccggcggaggcccgcttcagcagcggctgcgtgccaccccacagagcggccaccagcaccagagccaacacctgccctgaatgcagacgagggcggagacccataatccggaagtgacctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagctttttt

SEQ ID NO: 131187 - DNA, 1458 bp, Homo sapiens
  Payload ID: 5616
  Gene Symbol: EIF3I
  Gene Name: eukaryotic translation initiation factor 3, subunit I
  Uniprot ID: Q13347
  ENST ID: ENST00000373586
  CDS Start-End: 73-1050
ataatccggaagtgacctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagata

SEQ ID NO: 131188 - DNA, 2569 bp, Homo sapiens
  Payload ID: 5617
  Gene Symbol: EIF3J
  Gene Name: eukaryotic translation initiation factor 3, subunit J
  Uniprot ID: O75822
  ENST ID: ENST00000261868
  CDS Start-End: 139-915
ggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactggaa

SEQ ID NO: 131189 - DNA, 1550 bp, Homo sapiens
  Payload ID: 5617
  Gene Symbol: EIF3J
  Gene Name: eukaryotic translation initiation factor 3, subunit J
  Uniprot ID: O75822
  ENST ID: ENST00000424492
  CDS Start-End: 71-700
agtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaagttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactaca

SEQ ID NO: 131190 - DNA, 925 bp, Homo sapiens
  Payload ID: 5617
  Gene Symbol: EIF3J
  Gene Name: eukaryotic translation initiation factor 3, subunit J
  Uniprot ID: O75822
  ENST ID: ENST00000535391
  CDS Start-End: 13-627
acccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttgtggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaa

SEQ ID NO: 131191 - DNA, 533 bp, Homo sapiens
  Payload ID: 5617
  Gene Symbol: EIF3J
  Gene Name: eukaryotic translation initiation factor 3, subunit J
  ENST ID: ENST00000536248
  CDS Start-End: 1-319
attacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaaggtaagagcaagctgtgtagggaaatgggtattaaattagagtggggttataggtctaacagtcaacaaatataataggagcctgtcctaattaaaagtcaagcaactcactaataccatttaagttagactagaagaggagtatgggtgctattactgtccttttgtttccagacatgttccccttttctgagttaatagaaattgctgaaatcacagactgggttcaaatactagcactgctacttaatagg

SEQ ID NO: 131192 - DNA, 1024 bp, Homo sapiens
  Payload ID: 5617
  Gene Symbol: EIF3J
  Gene Name: eukaryotic translation initiation factor 3, subunit J
  ENST ID: ENST00000558353
  CDS Start-End: 1-352
ttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggaatttcctcctgaaaagtttcttacttgctacctactacccacaaaggactgatatggtacagtaccgggattgttca

SEQ ID NO: 131193 - DNA, 864 bp, Homo sapiens
  Payload ID: 5618
  Gene Symbol: EIF3K
  Gene Name: eukaryotic translation initiation factor 3, subunit K
  Uniprot ID: Q9UBQ5
  ENST ID: ENST00000248342
  CDS Start-End: 173-829
ggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcc

SEQ ID NO: 131194 - DNA, 1327 bp, Homo sapiens
  Payload ID: 5618
  Gene Symbol: EIF3K
  Gene Name: eukaryotic translation initiation factor 3, subunit K
  Uniprot ID: Q9UBQ5
  ENST ID: ENST00000545173
  CDS Start-End: 77-712
cctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtctgcacctgccagattccattcaccttgtgtcttggggctcccgcccaggaggaatagcggggagctgggtgatcttccctggaacttctaggccctgtgtcctgccccatagcactcagcaagacttcctggggcccagcggggcctcacagggggtctctgcacccttatttgtccctgaggcctgtctcgttggccatcttttattcttggggtgcccaagcctcatgtgcagacttggaatccggtgaacagtaggaatcttgattctctagtttgggtgattccacatttttgtgcctcagttttctcatctaaaaaatggggacgactgcaacagtaactatgataaacactgtgtaggtccttacacttacatcatttgatcctcagttgctaaatgatataaatagtatcatacctacctcatggcatcataagtgtgaatgcatgtataacacttagcaaagagctaagtgaccacacagttcattaaatgttcattatgac

SEQ ID NO: 131195 - DNA, 966 bp, Homo sapiens
  Payload ID: 5618
  Gene Symbol: EIF3K
  Gene Name: eukaryotic translation initiation factor 3, subunit K
  ENST ID: ENST00000538434
  CDS Start-End: 236-610
acctcttcctgttcccgtccttgaggacgccgtgccgggtcagtgttagcctccagccctggttgtggaaggcgacagaagtcatggcgatgtttgagcagatgagagccaacgtgggcaagttgctcaagggtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgagtggtgacccacggcctcgggctttggggctaagggggtgcccctcaagggaggccgaggcaggggcccagaggacctgggtagatctgctcgtgttctgggctgggaagtctgcacctgccagattccattcaccttgtgtcttggggctcccgcccaggaggaatagcggggagctgggtgatcttccctggaacttctaggccctgtgtcctgccccatagcactcagcaagacttcctggggcccagcggggcctcacagggggtctctgcacccttatttgtccctgaggcctgtctcgttggccatcttttattcttggggtgcccaagcctcatgtgcagacttggaatccggtga

SEQ ID NO: 131196 - DNA, 760 bp, Homo sapiens
  Payload ID: 5618
  Gene Symbol: EIF3K
  Gene Name: eukaryotic translation initiation factor 3, subunit K
  ENST ID: ENST00000593149
  CDS Start-End: 332-727
ccggaaagcgtggcggctgctgctagagcctttccctttaccgcacccaaggagctggagcgacaacaacgacgtcgtttccgtttccaccacctcttcctgttcccgtccttgaggacgccgtgccgggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcag

SEQ ID NO: 131197 - DNA, 583 bp, Homo sapiens
  Payload ID: 5618
  Gene Symbol: EIF3K
  Gene Name: eukaryotic translation initiation factor 3, subunit K
  ENST ID: ENST00000591409
  CDS Start-End: 74-583
gttcccgtccttgaggacgccgtgccgggtcagtgttagcctccagccctggttgtggaaggcgacagaagtcatggcgatgtttgagcagatgagagccaacgtgggcaagttgctcaagggtatcgacaggtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggag

SEQ ID NO: 131198 - DNA, 670 bp, Homo sapiens
  Payload ID: 5618
  Gene Symbol: EIF3K
  Gene Name: eukaryotic translation initiation factor 3, subunit K
  ENST ID: ENST00000592558
  CDS Start-End: 59-637
gacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcag

SEQ ID NO: 131199 - DNA, 501 bp, Homo sapiens
  Payload ID: 5618
  Gene Symbol: EIF3K
  Gene Name: eukaryotic translation initiation factor 3, subunit K
  ENST ID: ENST00000588934
  CDS Start-End: 84-497
acctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctgggtgtgtccagcatcatggcctcctcccagtaacttcaggtgtttaataaagatgtgttgactca

SEQ ID NO: 131200 - DNA, 780 bp, Homo sapiens
  Payload ID: 5618
  Gene Symbol: EIF3K
  Gene Name: eukaryotic translation initiation factor 3, subunit K
  ENST ID: ENST00000614624
  CDS Start-End: 188-745
agtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagcc

SEQ ID NO: 131201 - DNA, 780 bp, Homo sapiens; identical to SEQ ID NO: 131200
  Payload ID: 5618
  Gene Symbol: EIF3K
  Gene Name: eukaryotic translation initiation factor 3, subunit K
  ENST ID: ENST00000634230
  CDS Start-End: 188-745

SEQ ID NO: 131202 - DNA, 670 bp, Homo sapiens; identical to SEQ ID NO: 131198
  Payload ID: 5618
  Gene Symbol: EIF3K
  Gene Name: eukaryotic translation initiation factor 3, subunit K
  ENST ID: ENST00000634491
  CDS Start-End: 59-637

SEQ ID NO: 131203 - DNA, 966 bp, Homo sapiens; identical to SEQ ID NO: 131195
  Payload ID: 5618
  Gene Symbol: EIF3K
  Gene Name: eukaryotic translation initiation factor 3, subunit K
  ENST ID: ENST00000634857
  CDS Start-End: 236-610

SEQ ID NO: 131204 - DNA, 1327 bp, Homo sapiens; identical to SEQ ID NO: 131194
  Payload ID: 5618
  Gene Symbol: EIF3K
  Gene Name: eukaryotic translation initiation factor 3, subunit K
  ENST ID: ENST00000635417
  CDS Start-End: 77-712

SEQ ID NO: 131205 - DNA, 864 bp, Homo sapiens; identical to SEQ ID NO: 131193
  Payload ID: 5618
  Gene Symbol: EIF3K
  Gene Name: eukaryotic translation initiation factor 3, subunit K
  ENST ID: ENST00000635567
  CDS Start-End: 173-829

SEQ ID NO: 131206 - DNA, 583 bp, Homo sapiens; identical to SEQ ID NO: 131197
  Payload ID: 5618
  Gene Symbol: EIF3K
  Gene Name: eukaryotic translation initiation factor 3, subunit K
  ENST ID: ENST00000634420
  CDS Start-End: 74-583

SEQ ID NO: 131207 - DNA, 760 bp, Homo sapiens; identical to SEQ ID NO: 131196
  Payload ID: 5618
  Gene Symbol: EIF3K
  Gene Name: eukaryotic translation initiation factor 3, subunit K
  ENST ID: ENST00000634474
  CDS Start-End: 332-727

SEQ ID NO: 131208 - DNA, 501 bp, Homo sapiens; identical to SEQ ID NO: 131199
  Payload ID: 5618
  Gene Symbol: EIF3K
  Gene Name: eukaryotic translation initiation factor 3, subunit K
  ENST ID: ENST00000634882
  CDS Start-End: 84-497

SEQ ID NO: 131209 - DNA, 1599 bp, Homo sapiens
  Payload ID: 5619
  Gene Symbol: EIF3L
  Gene Name: eukaryotic translation initiation factor 3, subunit L
  Uniprot ID: Q9Y262
  ENST ID: ENST00000381683
  CDS Start-End: 34-1584
ctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacaca

SEQ ID NO: 131210 - DNA, 2282 bp, Homo sapiens
  Payload ID: 5619
  Gene Symbol: EIF3L
  Gene Name: eukaryotic translation initiation factor 3, subunit L
  ENST ID: ENST00000406934
  CDS Start-End: 716-2116
aggtaaggtggccgtaagggcgcggtgggctccacgacggggtgatctctgggaccactggatgtgggtcccggcgcgaggcagcttccgggtcgcggccagctccggccgacctcccgcccggccctcaggctgctcccacagttcccggtccctagacaaccctggctctgcccgcccacttcgcgtgttcgattggcttgtccttcccctttctaagaccggagactaaggcctgttagacgtttctgtgtttctgcacctgagtttttttggtctaggctccgtctggtcaaatctcgctgattcccacagcctcttgtcctttgctccacctcattgcacccgtaatgttgtattgtcattgtctgtttactgtcccttttctctaaggcgtgtgagttcctcaaaggcaggcacagtgtcttattcgcctctgtatccttagctctctgcttggcatctagactctaggatgagcgttttgaattcacgacttggcggctgtccttgactgtgtctctttccttctaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccag

SEQ ID NO: 131211 - DNA, 583 bp, Homo sapiens
  Payload ID: 5619
  Gene Symbol: EIF3L
  Gene Name: eukaryotic translation initiation factor 3, subunit L
  ENST ID: ENST00000451427
  CDS Start-End: 134-583
cacagttcccggtccctagacaaccctggctctgcccgcccacttcgcgtgttcgattggcttgtccttcccctttctaagaccggagactaaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgct

SEQ ID NO: 131212 - DNA, 581 bp, Homo sapiens
  Payload ID: 5619
  Gene Symbol: EIF3L
  Gene Name: eukaryotic translation initiation factor 3, subunit L
  ENST ID: ENST00000414316
  CDS Start-End: 31-581
tttccggcggtgctcgcaagcgaggcagccatgtcttatcccgctgatgattatgagtctgaggcggcttatgacccctacgcttatcccagcgactatgatatgcacacagagacgaggtttcgccgtgttgtccaggctggtcttgaactcctgacctcaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacat

SEQ ID NO: 131213 - DNA, 574 bp, Homo sapiens
  Payload ID: 5619
  Gene Symbol: EIF3L
  Gene Name: eukaryotic translation initiation factor 3, subunit L
  ENST ID: ENST00000436452
  CDS Start-End: 1-123
tttccggcggtgctcgcaagcgaggcagccatgtcttatcccgctgatgattatgagtctgaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcag

SEQ ID NO: 131214 - DNA, 787 bp, Homo sapiens
  Payload ID: 5619
  Gene Symbol: EIF3L
  Gene Name: eukaryotic translation initiation factor 3, subunit L
  ENST ID: ENST00000439997
  CDS Start-End: 1-384
atttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacaggtatgggctactggctgaaagggcctctttctgggtgggactggcctggtaatatagttcctacaaatgagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatag

SEQ ID NO: 131215 - DNA, 520 bp, Homo sapiens
  Payload ID: 5619
  Gene Symbol: EIF3L
  Gene Name: eukaryotic translation initiation factor 3, subunit L
  ENST ID: ENST00000450376
  CDS Start-End: 1-330
cagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagatggagtcttgtgctgtcacccatgctggagtgcagcgacgtgatcttagctcactgcaacctctgcctcctgggttcaagcgagtctccctcctcagcctcccgcatagctggaattacagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccaga

SEQ ID NO: 131216 - DNA, 3220 bp, Homo sapiens
  Payload ID: 5619
  Gene Symbol: EIF3L
  Gene Name: eukaryotic translation initiation factor 3, subunit L
  ENST ID: ENST00000412331
  CDS Start-End: 454-2277
aactttgcctctcctttacgccaaatacgtgtccttatatctgaatctacaccactattatagattcaccttctttgagaagtccctatttgaagagaggaaaattcaggctacttgtaaccctcttattctttttagacggagttttccctcttgttgcccaggctagagtgcaatggcgcgatctcggctcaccgcaacctccgcctcccgggttcaagcgactctcctgcctcagcctcccgagtagctggaattacaggcatgcgccaccactcccggctaattttgtatttttagtagagacggggtttctccatattggtcaggctggtctcaaacccccggcctcagcctcaggtgatccgcccgcctcggcctcccaaactggtggggttacaggtgtgagccacggaacgcggctcctcttccttctggatatggctgtctcagatggccagaggcctcggaaaggcttccggtttcccggcaggcccgagtggggctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttagacggagtctcactctgtcgcccaggttggagtgtactggcgcgatctcggctcactgcaagctccacctcccaggttcctgccattctcctgcctcagcctcccaagtagctgggactacaggcacccgccaccatgcccggccaattttttgtattttttagtagagatggggtttcaccgtgttagccaggatggtctcagatttcctgacctcgtgatctgcccatctctgcctcctaaagtactgggattacaggcgtgagccaccgtgcccagccctaaattgaattcttaaatccctcttgttcataaagcagtatatttggtttacagga

SEQ ID NO: 131217 - DNA, 2091 bp, Homo sapiens
  Payload ID: 5619
  Gene Symbol: EIF3L
  Gene Name: eukaryotic translation initiation factor 3, subunit L
  Uniprot ID: Q9Y262
  ENST ID: ENST00000624234
  CDS Start-End: 79-1773
gctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtct

SEQ ID NO: 131218 - DNA, 889 bp, Homo sapiens
  Payload ID: 5620
  Gene Symbol: EIF3M
  Gene Name: eukaryotic translation initiation factor 3, subunit M
  ENST ID: ENST00000323213
  CDS Start-End: 317-889
gtcggcgtggtcttgcgagtggagtgtccgctgtgcccgggcctgcaccatgagcgtcccggccttcatcgacatcagtgaagaagatcagtttttcagaaagaggacagaatttgagattgtgctttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaag

SEQ ID NO: 131219 - DNA, 662 bp, Homo sapiens
  Payload ID: 5620
  Gene Symbol: EIF3M
  Gene Name: eukaryotic translation initiation factor 3, subunit M
  ENST ID: ENST00000526267
  CDS Start-End: 1-662
aaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagttgctcaggagaattagaaggcttaggatcaatatgtcatagcacacatcggacatttggaaaacagcagtggcaacaactgtatgacacacttaatgcctggaaacaaaatctgaacaaagtgaaaaacagcct

SEQ ID NO: 131220 - DNA, 1645 bp, Homo sapiens
  Payload ID: 5620
  Gene Symbol: EIF3M
  Gene Name: eukaryotic translation initiation factor 3, subunit M
  ENST ID: ENST00000524711
  CDS Start-End: 41-220
gtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattaaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttc

SEQ ID NO: 131221 - DNA, 749 bp, Homo sapiens
  Payload ID: 5620
  Gene Symbol: EIF3M
  Gene Name: eukaryotic translation initiation factor 3, subunit M
  ENST ID: ENST00000533439
  CDS Start-End: 444-749
ctggggcgcgcgttcctggcctcgattcgcaccagctcgccggccggcggtcccagcgcggggcccgacgcttcaccgccagctccctggtcggcgtcgggactcatttctgacgacatagtacttttagactgatgaggaatgatgtctgcttccgtccgtcaaatgcagccacattcggagtgggaggtggtgaatctgtagttagcataagcaggtttttcagaaagaggacagaatttgagattgtgctttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacaccctttta

SEQ ID NO: 131222 - DNA, 2236 bp, Homo sapiens
  Payload ID: 5620
  Gene Symbol: EIF3M
  Gene Name: eukaryotic translation initiation factor 3, subunit M
  ENST ID: ENST00000525782
  CDS Start-End: 57-281
ttttccggtcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattaaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacggtaaggcagacagaacattttcatttatttctagaatttctcatctactacatggatcatagtaagatttttatctggaaactgagccttacacaacaaagatttgtttatagcagatgtgtatttagtagattagtggatatatttgttgtagggtgaaaatttagtagaaatataaactgctatattctatcccttgaaatcacgtagaacaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaacttaactgctcaggaattttttctgagctttttaaatttgaaagttgggattatgcaattaagattaataaaaggtacagaactattgaccttttttcccctaatgctctaagttttctatgaagaagtaataacttagtaggaaattagtttattcccctatatgagatggtaggggaagaacacctagcattcttt

SEQ ID NO: 131223 - DNA, 1697 bp, Homo sapiens
  Payload ID: 5620
  Gene Symbol: EIF3M
  Gene Name: eukaryotic translation initiation factor 3, subunit M
  ENST ID: ENST00000531921
  CDS Start-End: 91-462
agttgcgccagcagcgtcgcgcggcccagttcccttttccggtcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattaaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagtttta

SEQ ID NO: 131224 - DNA, 633 bp, Homo sapiens
  Payload ID: 5620
  Gene Symbol: EIF3M
  Gene Name: eukaryotic translation initiation factor 3, subunit M
  ENST ID: ENST00000532444
  CDS Start-End: 51-143
ggtcggcgtggtcttgcgagtggagtgtccgctgtgcccgggcctgcaccatgagcgtcccggccttcatcgacatcagtgaagaagatcaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacag

SEQ ID NO: 131225 - DNA, 5051 bp, Homo sapiens
  Payload ID: 5620
  Gene Symbol: EIF3M
  Gene Name: eukaryotic translation initiation factor 3, subunit M
  Uniprot ID: Q7L2H7
  ENST ID: ENST00000531120
  CDS Start-End: 64-1188
agttcccttttccggtcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgttgtttttttccaacgtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctgggaaagataaactaattttaccttcgaaattattatacaaaagattttaaagagtctgtaaagcctctgcagttatgagtatgtggtaaaaccaccatctcttggctgatttccactaccttagtagttctggcaccagaaaagtatacaatgtgaatgtgtaggcttatgtagtagatcttcaaaatctctaatatataactgaagtaaagtgtacaaaaactgccttttactacttcatgtttcctcccatgcttcagaacaccattgttgaagaaacaggaagggcagtgagatatttggaagttggcatgttttcaagacactgtattgggtaattttaaaaatagtgtgttaaataactttttcattttaaggttcttttctgatgttaaaatacttactggaaatttagaaaatagagtaaagtagaaagaaactaaaaatcattagtaatcccttatccagagaggcttgttgacattttggtattatttgctgctagcgtttttttctatttttagcctatttgatcattctatagaattttatgtattttcctctgtgagcagtttcttaggtcattaaaaacaattgtctatggctgcaaaatactcccttttatggatgtttgatatatctcctactactgaatgtttgtttccagtttatccctaccaaaaattaattcgagttaatttcatgcaaaacaatctttgatgtttttgagagattcccagataaaattttctcttcaaaaggaatactgggccaggcactgtgactcatacctgtaatcccagcactttgggaaactgaggcgagtggattgcatgagctcaggagtcgaaaactagcctgagcaacatggcaaaaccccatctctaccaaaaattagctgggcatggtggcatgcaactgtagtcccagctcctcggagggctgaggtgcaaggatcatttgagcccaggaggtgaaggttgcaatgagccaagatcatgccattgcactccagcctggacaacagagtgagaccctctctcaaaaataaataatagataaaacaaaaggaatactgaattgttttcaaaataacaattatggtgggctttcttttaagatagggtctcaccctgtcacctaggctggagtgcagtggcacaatcacagctcattgcagccttgacctccctggattcaggtgatcctcccaccttcacctcctgagtaccttggactacaggcatgtgccaccacacccaggtaatttttgtattttttgccatgttgcccaggctggtctctcttaactcttgggctcaagtgatctgaccatctcggtctcccaaagttctaggattacaggagtgagccatactgtgttgtgttttagttgaaagggatatacacgtgtattttagaaatatgaaacaggataagaattacattaaaatcacccaagatcccaaccaccattaaagagtttgtgtaaatcttctggtctcttttctgtatacactttttaaatactggggtcatatttttattggtttatatgctatgttaaacatttttagcatttcctcctgttcttaagtctgttaagaggatagctccatcatattctgtgttctgcaaattatttctggacatttaaattgtaagaaaatggtcactgttaactaggctgcagtgattatcatttgttcataaatctttgtgaagatctttgggtactgccttacattaaaatctttttcaatttgaccagtaaaagtggcatgttagtaacattgtcattttcagtgttagattatgtagtactaagtttattttattttatttttgagacagagtcttgcactgtcgcccaggctggagtgcagtggcgccatctcagctcactgcaacctccacctcccaggttcaagcgattcttctgcctcagcctcccgagtagctgggattacaggcacccaccacgatgcccagctaattttttgtatttttagtagagacagggtttcactatgttgtccaggctggtctcgaacgcctgacctcatgatccacctgcctcggcctcccaaagtgttgggattacaggcatgagccaccctgcccgacctagtaatacttttttttttttttttttttaatgaacttaaatgtttagaatggtaagttcacggctccctaaggagtgttccttttggattgctctgtttggctccctccctgaaatcctatagtcagccactggtcccctcagagagttttacctctgatctttggggtgattctttgttcatatttatctgattggctttgttcttccaaaagtgtctgcacaggactgctaagagaacctaggcaagtcatttaatttttctgggcttcagtttactcattagcttcttttagttcccagatgctattactggaaagaataactagtaatggataaaaacctacataaatatttcctattttgccatcaaagtgctgggttcattttggtgtatttggcatccaagtacaaattaacagtttcccaaaatcctgattctttgacttttttatcttgatgatggaaaggaaggacacgtttacttgctttagtttctttccccttaactacccacttgctgagaggggtaggagcagggattggctttagagaaacaagatacagtgtagattagctaatgtttgcgcttaacaaaacttgtcctgtttaacttacctgagggttctgcagcctaccgcagtaattttagttctagctgttttcagatatattgccttgtatcttcgttctttcgtctcctatcctttttagaaatttatcacctgtttctctttcagcctgacttacaaaatctaatttttggcctaaaaatttcccctagcttggtactagtccttttatttctgcctgtgattatattttaaaattaaacttaaatgaatctaattcattggatatataaaaaaaaaagtaagtggcttgctttgcttactctggttttccatcctcattcctggatataatcaagattgcagtaggctaacaatctaatgctgaaaacaagaatgaaaaacataccatcttttcaagttactttggacccatagagagaaagtggattggtacttaataccttccctgaatttaacagaattgatgtggactgtacataaaatatgttgaaaaataaaactatttttttggctat

SEQ ID NO: 131226 - DNA, 1207 bp, Homo sapiens
  Payload ID: 5620
  Gene Symbol: EIF3M
  Gene Name: eukaryotic translation initiation factor 3, subunit M
  Uniprot ID: Q7L2H7
  ENST ID: ENST00000524896
  CDS Start-End: 55-783
ttccggtcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctg

SEQ ID NO: 131227 - DNA, 5516 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000346169
  CDS Start-End: 272-5071
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 131228 - DNA, 4990 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000350481
  CDS Start-End: 238-4545
ggaaatggttgtggactacgtctgtgcggctgcgtggggctcggccgcgcggactgaaggagactgaaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 131229 - DNA, 5009 bp, Homo sapiens
  Payload ID: 5621
  Gene Symbol: EIF4G1
  Gene Name: eukaryotic translation initiation factor 4 gamma, 1
  ENST ID: ENST00000319274
  CDS Start-End: 369-4556
tctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgagaacgcctcaaaggggtcattgacctcatttttgagaaggccatttcagagcccaacttctctgtggcctatgcaacatgtgccgctgcctcatggcgctgaaagtgcccactacggaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtccaagaccattgaccagatccataaggaggctgagatggaagacatcgagagcacatcaaagtgcagcagctcatccaagggcagtgacaagcgtcggggcggtcctccaggccctcccatcagccgtggacttccccttgtggatgatggtggctaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcgggtgaacggggaggggaccgtggggaccggcttgatcgtgcgcacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgaggaaggagctacaggcgctctacgcctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 131230 - DNA, 5484 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000352767
  CDS Start-End: 215-5035
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctc

SEQ ID NO: 131231 - DNA, 5667 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000342981
  CDS Start-End: 415-5217
acttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 131232 - DNA, 5129 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000382330
  CDS Start-End: 200-5020
agaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtag

SEQ ID NO: 131233 - DNA, 5229 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000392537
  CDS Start-End: 248-4786
gtgggggcgccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 131234 - DNA, 2808 bp, Homo sapiens
  Payload ID: 5621
  Gene Symbol: EIF4G1
  Gene Name: eukaryotic translation initiation factor 4 gamma, 1
  ENST ID: ENST00000413967
  CDS Start-End: 199-414
gaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatgg

SEQ ID NO: 131235 - DNA, 2658 bp, Homo sapiens
  Payload ID: 5621
  Gene Symbol: EIF4G1
  Gene Name: eukaryotic translation initiation factor 4 gamma, 1
  ENST ID: ENST00000450424
  CDS Start-End: 158-2658
cggctgcgcctgcggagaagcggtggccgccgagcgggatctgtgcggggagccggaaatggttgtggactacgtctgtgcggctgcgtggggctcggccgcgcggactgaaggagactgaaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagcc

SEQ ID NO: 131236 - DNA, 5569 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000414031
  CDS Start-End: 445-5124
gcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 131237 - DNA, 677 bp, Homo sapiens
  Payload ID: 5621
  Gene Symbol: EIF4G1
  Gene Name: eukaryotic translation initiation factor 4 gamma, 1
  ENST ID: ENST00000448284
  CDS Start-End: 1-677
aaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaaggtagggcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggac

SEQ ID NO: 131238 - DNA, 4683 bp, Homo sapiens
  Payload ID: 5621
  Gene Symbol: EIF4G1
  Gene Name: eukaryotic translation initiation factor 4 gamma, 1
  ENST ID: ENST00000411531
  CDS Start-End: 1-4683
atgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactga

SEQ ID NO: 131239 - DNA, 750 bp, Homo sapiens
  Payload ID: 5621
  Gene Symbol: EIF4G1
  Gene Name: eukaryotic translation initiation factor 4 gamma, 1
  ENST ID: ENST00000422614
  CDS Start-End: 1-541
gctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagagaatctggggatcatttgtttctcccatacaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctccca

SEQ ID NO: 131240 - DNA, 2384 bp, Homo sapiens
  Payload ID: 5621
  Gene Symbol: EIF4G1
  Gene Name: eukaryotic translation initiation factor 4 gamma, 1
  ENST ID: ENST00000444861
  CDS Start-End: 114-2384
taaagggctggagacaggaactagactcaagttaaatggaacaggctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtc

SEQ ID NO: 131241 - DNA, 4311 bp, Homo sapiens
  Payload ID: 5621
  Gene Symbol: EIF4G1
  Gene Name: eukaryotic translation initiation factor 4 gamma, 1
  ENST ID: ENST00000441154
  CDS Start-End: 1-4311
atgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactga

SEQ ID NO: 131242 - DNA, 983 bp, Homo sapiens
  Payload ID: 5621
  Gene Symbol: EIF4G1
  Gene Name: eukaryotic translation initiation factor 4 gamma, 1
  ENST ID: ENST00000457456
  CDS Start-End: 129-983
ctacgagagcagccagatgggctgaaagtggaactcaaggggtttctggcacctacctacctgcttcccgctgggggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagag

SEQ ID NO: 131243 - DNA, 5129 bp, Homo sapiens
  Payload ID: 5621
  Gene Symbol: EIF4G1
  Gene Name: eukaryotic translation initiation factor 4 gamma, 1
  ENST ID: ENST00000442406
  CDS Start-End: 293-445
ccggctgcgcctgcggagaagcggtggccgccgagcgggatctgtgcggggagccggaaatggttgtggactacgtctgtgcggctgcgtggggctcggccgcgcggactgaaggagactgaaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccaggcagagctaaagtagaaatggctctagtaaagaagggttgtgggactcttcagtgcaaacttggtaaccctttgtgtcctgcagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 131244 - DNA, 2907 bp, Homo sapiens
  Payload ID: 5621
  Gene Symbol: EIF4G1
  Gene Name: eukaryotic translation initiation factor 4 gamma, 1
  ENST ID: ENST00000426123
  CDS Start-End: 198-2907
aagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatgg

SEQ ID NO: 131245 - DNA, 4668 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000435046
  CDS Start-End: 18-4229
atatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattc

SEQ ID NO: 131246 - DNA, 578 bp, Homo sapiens
  Payload ID: 5621
  Gene Symbol: EIF4G1
  Gene Name: eukaryotic translation initiation factor 4 gamma, 1
  ENST ID: ENST00000440448
  CDS Start-End: 148-578
gactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacagtaccctgtgcagccaggagccccaggcttctatccaggtgcaagccctacagaatttgggacctacgctggcgcctactatccagcccaaggggtgcagcagtttcc

SEQ ID NO: 131247 - DNA, 558 bp, Homo sapiens
  Payload ID: 5621
  Gene Symbol: EIF4G1
  Gene Name: eukaryotic translation initiation factor 4 gamma, 1
  ENST ID: ENST00000444134
  CDS Start-End: 177-558
gccggctgcgcctgcggagaagcggtggccgccgagcgggatctgtgcggggagccggaaatggttgtggactacgtctgtgcggctgcgtggggctcggccgcgcggactgaaggagactgaagatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaaccca

SEQ ID NO: 131248 - DNA, 5038 bp, Homo sapiens
  Payload ID: 5621
  Gene Symbol: EIF4G1
  Gene Name: eukaryotic translation initiation factor 4 gamma, 1
  ENST ID: ENST00000427845
  CDS Start-End: 497-5038
tcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactga

SEQ ID NO: 131249 - DNA, 596 bp, Homo sapiens
  Payload ID: 5621
  Gene Symbol: EIF4G1
  Gene Name: eukaryotic translation initiation factor 4 gamma, 1
  ENST ID: ENST00000427607
  CDS Start-End: 108-596
gagctggggcagggactacgagagcagccagatgggctgaaagtggaactcaagggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcat

SEQ ID NO: 131250 - DNA, 730 bp, Homo sapiens
  Payload ID: 5621
  Gene Symbol: EIF4G1
  Gene Name: eukaryotic translation initiation factor 4 gamma, 1
  ENST ID: ENST00000427141
  CDS Start-End: 455-730
gcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacg

SEQ ID NO: 131251 - DNA, 524 bp, Homo sapiens
  Payload ID: 5621
  Gene Symbol: EIF4G1
  Gene Name: eukaryotic translation initiation factor 4 gamma, 1
  ENST ID: ENST00000428387
  CDS Start-End: 94-524
agtgagccgattgggttctagatgggggtcctgggccccaggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagtt

SEQ ID NO: 131252 - DNA, 5026 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000434061
  CDS Start-End: 369-4583
tctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 131253 - DNA, 2755 bp, Homo sapiens
  Payload ID: 5621
  Gene Symbol: EIF4G1
  Gene Name: eukaryotic translation initiation factor 4 gamma, 1
  ENST ID: ENST00000421110
  CDS Start-End: 148-2755
tgcggagaagcggtggccgccgagcgggatctgtgcggggagccggaaatggttgtggactacgtctgtgcggctgcgtggggctcggccgcgcggactgaaggagactgaaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttg

SEQ ID NO: 131254 - DNA, 542 bp, Homo sapiens
  Payload ID: 5621
  Gene Symbol: EIF4G1
  Gene Name: eukaryotic translation initiation factor 4 gamma, 1
  ENST ID: ENST00000455679
  CDS Start-End: 282-542
aaatggttgtggactacgtctgtgcggctgcgtggggctcggccgcgcggactgaaggagactgaaggtgctggggggaccctgatgtggcaccaaatgaaatgaacaaagctccacagtccacaggccccccacccgccccatcccccggactcccacagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagcccca

SEQ ID NO: 131255 - DNA, 694 bp, Homo sapiens
  Payload ID: 5621
  Gene Symbol: EIF4G1
  Gene Name: eukaryotic translation initiation factor 4 gamma, 1
  ENST ID: ENST00000456033
  CDS Start-End: 215-694
gtgctggggggaccctgatgtggcaccaaatgaaatgaacaaagctccacagtccacaggccccccacccgccccatcccccggactcccacagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccag

SEQ ID NO: 131256 - DNA, 5653 bp, Homo sapiens
  Payload ID: 5621
  Gene Symbol: EIF4G1
  Gene Name: eukaryotic translation initiation factor 4 gamma, 1
  Uniprot ID: Q04637
  ENST ID: ENST00000424196
  CDS Start-End: 390-5210
gccagcgagacctggaatttccggtctggttggtctggggccccgcggagccaggttgataccctcacctcccaaccccaggccctcggatgcccagaacctgtaggccgcaccgtggacttgttcttaatcgagggggtgagtgaggggtctgtttcagtaggtcaggggttggttggaagtgatgcgggtttgacagcatgttggtggggacaggctgtatcttttctgcttcaccctcttggcatctctgggactccgtatgggacccagcccttgcatcaaccctttcaccgccccatttgccttaagcttgggtcccttcctcttcctgagcgccactctttcccaacaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 131257 - DNA, 3978 bp, Homo sapiens
  Payload ID: 5622
  Gene Symbol: EIF4G2
  Gene Name: eukaryotic translation initiation factor 4 gamma, 2
  Uniprot ID: P78344
  ENST ID: ENST00000339995
  CDS Start-End: 493-3216
gcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 131258 - DNA, 3346 bp, Homo sapiens
  Payload ID: 5622
  Gene Symbol: EIF4G2
  Gene Name: eukaryotic translation initiation factor 4 gamma, 2
  ENST ID: ENST00000396525
  CDS Start-End: 91-2700
gaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgaga

SEQ ID NO: 131259 - DNA, 573 bp, Homo sapiens
  Payload ID: 5622
  Gene Symbol: EIF4G2
  Gene Name: eukaryotic translation initiation factor 4 gamma, 2
  ENST ID: ENST00000532570
  CDS Start-End: 185-573
agacacgccttagcgccagcagtgagtcggagctctatggaggtggcagcgggtaccgagaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctc

SEQ ID NO: 131260 - DNA, 1969 bp, Homo sapiens
  Payload ID: 5622
  Gene Symbol: EIF4G2
  Gene Name: eukaryotic translation initiation factor 4 gamma, 2
  ENST ID: ENST00000531416
  CDS Start-End: 638-1969
aaagagctgggcgccgggctggcgggggtggcctcagctgctcctccccgtcgagcgacccgggcctcgcggggaggttgtcggaagcacttccctaacttgcgcctgggtgggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatagtagaatgtggctttttcaaaagattcgttctgagccgtttaaaatgctcttgtgttctacgaagtctctttgcatccttgaacaccggggaatttccaggtggctaaacaaaatgtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccagattagcctgaggcctgctcagtcgttcctaatg

SEQ ID NO: 131261 - DNA, 1069 bp, Homo sapiens
  Payload ID: 5622
  Gene Symbol: EIF4G2
  Gene Name: eukaryotic translation initiation factor 4 gamma, 2
  ENST ID: ENST00000532082
  CDS Start-End: 223-1069
aggcgtcccggagcctggcctcccggcggggaggtgtgtaggacctggagtcggcaggggctgcccttcgtcggggaggaaagagagagtgatgatttctgccccttttgtcagcagaggaggccgtggcgaggcggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgct

SEQ ID NO: 131262 - DNA, 579 bp, Homo sapiens
  Payload ID: 5622
  Gene Symbol: EIF4G2
  Gene Name: eukaryotic translation initiation factor 4 gamma, 2
  ENST ID: ENST00000531647
  CDS Start-End: 40-294
attattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagagggatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagttta

SEQ ID NO: 131263 - DNA, 591 bp, Homo sapiens
  Payload ID: 5622
  Gene Symbol: EIF4G2
  Gene Name: eukaryotic translation initiation factor 4 gamma, 2
  ENST ID: ENST00000530211
  CDS Start-End: 244-591
agcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactg

SEQ ID NO: 131264 - DNA, 3654 bp, Homo sapiens
  Payload ID: 5622
  Gene Symbol: EIF4G2
  Gene Name: eukaryotic translation initiation factor 4 gamma, 2
  ENST ID: ENST00000525681
  CDS Start-End: 168-2891
ctgaaatacgttgtaattgaatgaaggcttatagatctgtatgttagcagtgtctaattttggtgctctttctcgttccaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgat

SEQ ID NO: 131265 - DNA, 557 bp, Homo sapiens
  Payload ID: 5622
  Gene Symbol: EIF4G2
  Gene Name: eukaryotic translation initiation factor 4 gamma, 2
  ENST ID: ENST00000531180
  CDS Start-End: 1-557
atgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctgttagctaaattacaagatcgagaatggttaacagaactttttcaacaaagcaaggtcaatatgcagaaaatgctccc

SEQ ID NO: 131266 - DNA, 4001 bp, Homo sapiens
  Payload ID: 5622
  Gene Symbol: EIF4G2
  Gene Name: eukaryotic translation initiation factor 4 gamma, 2
  ENST ID: ENST00000526148
  CDS Start-End: 512-3235
gggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatagtagaatgtggctttttcaaaagattcgttctgagccgtttaaaatgctcttgtgttctacgaagtctctttgcatccttgaacaccggggaatttccaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccgcttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgta

SEQ ID NO: 131267 - DNA, 702 bp, Homo sapiens
  Payload ID: 5622
  Gene Symbol: EIF4G2
  Gene Name: eukaryotic translation initiation factor 4 gamma, 2
  ENST ID: ENST00000528839
  CDS Start-End: 1-702
atcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccag

SEQ ID NO: 131268 - DNA, 571 bp, Homo sapiens
  Payload ID: 5622
  Gene Symbol: EIF4G2
  Gene Name: eukaryotic translation initiation factor 4 gamma, 2
  ENST ID: ENST00000527419
  CDS Start-End: 306-571
agcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagaaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaa

SEQ ID NO: 131269 - DNA, 601 bp, Homo sapiens
  Payload ID: 5622
  Gene Symbol: EIF4G2
  Gene Name: eukaryotic translation initiation factor 4 gamma, 2
  ENST ID: ENST00000528562
  CDS Start-End: 307-447
cagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgc

SEQ ID NO: 131270 - DNA, 1286 bp, Homo sapiens
  Payload ID: 5622
  Gene Symbol: EIF4G2
  Gene Name: eukaryotic translation initiation factor 4 gamma, 2
  ENST ID: ENST00000524932
  CDS Start-End: 555-1286
agacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaagaaggaaaacgtcagtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcgggccggcagggaaggccaggccgttggcgcgggaccagggaaccgcaggcgtcccggagcctggcctcccggcggggaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactc

SEQ ID NO: 131271 - DNA, 563 bp, Homo sapiens
  Payload ID: 5622
  Gene Symbol: EIF4G2
  Gene Name: eukaryotic translation initiation factor 4 gamma, 2
  ENST ID: ENST00000530702
  CDS Start-End: 312-563
agcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagag

SEQ ID NO: 131272 - DNA, 555 bp, Homo sapiens
  Payload ID: 5622
  Gene Symbol: EIF4G2
  Gene Name: eukaryotic translation initiation factor 4 gamma, 2
  ENST ID: ENST00000527526
  CDS Start-End: 219-555
agtcctgtacacccggccccctctcgcgcgtctttccacgagctctccacggggaggaggcgaaagggtggacaggggaaaactgctgaagagctttcggagagacctcatctagtcgctggcctcgtcaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaag

SEQ ID NO: 131273 - DNA, 198 bp, Homo sapiens
  Payload ID: 5622
  Gene Symbol: EIF4G2
  Gene Name: eukaryotic translation initiation factor 4 gamma, 2
  ENST ID: ENST00000534605
  CDS Start-End: 1-62
acgaaaaagaacgacatgatgcaatcttcaggaaagtaagaggattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttc

SEQ ID NO: 131274 - DNA, 5802 bp, Homo sapiens
  Payload ID: 5623
  Gene Symbol: EIF4G3
  Gene Name: eukaryotic translation initiation factor 4 gamma, 3
  Uniprot ID: O43432
  ENST ID: ENST00000264211
  CDS Start-End: 196-4953
gtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaagaaagtaaa

SEQ ID NO: 131275 - DNA, 2179 bp, Homo sapiens
  Payload ID: 5623
  Gene Symbol: EIF4G3
  Gene Name: eukaryotic translation initiation factor 4 gamma, 3
  Uniprot ID: O43432
  ENST ID: ENST00000356916
  CDS Start-End: 498-2045
taacttagcgttgcttatggaaaacctgatggaatagcattgacccagtttacaaagccatctgaagtgcctgagttgtatttgaaggaatattttttcacctttggcttttagcttagaagttatgactgcacattacaaaggggaatgttcaaacctttatcacaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaaggtatatgtcacgaaaca

SEQ ID NO: 131276 - DNA, 5567 bp, Homo sapiens
  Payload ID: 5623
  Gene Symbol: EIF4G3
  Gene Name: eukaryotic translation initiation factor 4 gamma, 3
  Uniprot ID: O43432
  ENST ID: ENST00000374935
  CDS Start-End: 623-4540
gccggactgctggaggcggccacagcgccatgttggatgctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaagaaagtaaagtgacttctcctttggacagctgctgcatgtgtgcccattcctgggggtgctgtctggctatttattgtctaattcaaatcactcctgaggggagagagataaaacgagagagagtgagagagtgtgtgtatgtgcgtgtatgcgcacgtatgtgcatgcacatgtatgtatgtatat

SEQ ID NO: 131277 - DNA, 5762 bp, Homo sapiens
  Payload ID: 5623
  Gene Symbol: EIF4G3
  Gene Name: eukaryotic translation initiation factor 4 gamma, 3
  ENST ID: ENST00000400422
  CDS Start-End: 582-5447
ctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctatttgcaaagtgcagagcaggcatggattgccaattctggaacagagcaaagccccaacttgccctccactggtgatgtcacacccacccatgaagagcctgcctctagggttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaa

SEQ ID NO: 131278 - DNA, 1270 bp, Homo sapiens
  Payload ID: 5623
  Gene Symbol: EIF4G3
  Gene Name: eukaryotic translation initiation factor 4 gamma, 3
  ENST ID: ENST00000438975
  CDS Start-End: 619-1270
gactgctggaggcggccacagcgccatgttggatgctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagc

SEQ ID NO: 131279 - DNA, 1122 bp, Homo sapiens
  Payload ID: 5623
  Gene Symbol: EIF4G3
  Gene Name: eukaryotic translation initiation factor 4 gamma, 3
  ENST ID: ENST00000411888
  CDS Start-End: 463-1122
gttggatgctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacgaccccttatccctctggacagaatgcaggtccaaccacgctggtataccctcaaacccctcagacaatgaattcacaacctcaaacccgttctccgcccagcagaacagtgccaatacattgcacagacaactggaagaggaggaaggttttggaacagactcccgtttacaggtccttggctggaagaggctggataaaatactgcatttttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcag

SEQ ID NO: 131280 - DNA, 6196 bp, Homo sapiens
  Payload ID: 5623
  Gene Symbol: EIF4G3
  Gene Name: eukaryotic translation initiation factor 4 gamma, 3
  Uniprot ID: O43432
  ENST ID: ENST00000602326
  CDS Start-End: 585-5360
gctctgctcgttgagtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgggaggattcagacctatccagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagttt

SEQ ID NO: 131281 - DNA, 5325 bp, Homo sapiens
  Payload ID: 5623
  Gene Symbol: EIF4G3
  Gene Name: eukaryotic translation initiation factor 4 gamma, 3
  ENST ID: ENST00000634879
  CDS Start-End: 1-5325
gtgaagaaaatccaccggcatcgcctgagccccgctaccgagaagggcgccgcttcctccggggagggggataaagatcccccgccgccggcccatgaggatattgccgtgaaaggcacagcgactgcagcaggaaccggacccggcaccggagcggcggcggcggcggcagcagcggtaccgcctcctcacccggcggcggcagcagcggcggcggcggcggcggcggcggcggcggcggcagcggtcccccctcctcacccgaacatcagggccctccagactcaggcgccccaacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaa

SEQ ID NO: 131282 - DNA, 1756 bp, Homo sapiens
  Payload ID: 5624
  Gene Symbol: EIF4A1
  Gene Name: eukaryotic translation initiation factor 4A1
  Uniprot ID: P60842
  ENST ID: ENST00000293831
  CDS Start-End: 17-1237
ctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgc

SEQ ID NO: 131283 - DNA, 568 bp, Homo sapiens
  Payload ID: 5624
  Gene Symbol: EIF4A1
  Gene Name: eukaryotic translation initiation factor 4A1
  ENST ID: ENST00000579139
  CDS Start-End: 16-273
tagtttctaaggatcatgtctgcgagccaggattcccggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgagatccagagacaatggccccgatgggatggagcccgaaggcgtcatcgagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaagg

SEQ ID NO: 131284 - DNA, 577 bp, Homo sapiens
  Payload ID: 5624
  Gene Symbol: EIF4A1
  Gene Name: eukaryotic translation initiation factor 4A1
  ENST ID: ENST00000585024
  CDS Start-End: 15-577
agtttctaaggatcatgtctgcgagccaggattcccgagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccg

SEQ ID NO: 131285 - DNA, 696 bp, Homo sapiens
  Payload ID: 5624
  Gene Symbol: EIF4A1
  Gene Name: eukaryotic translation initiation factor 4A1
  ENST ID: ENST00000577929
  CDS Start-End: 442-696
aggggatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcagattgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacc

SEQ ID NO: 131286 - DNA, 710 bp, Homo sapiens
  Payload ID: 5624
  Gene Symbol: EIF4A1
  Gene Name: eukaryotic translation initiation factor 4A1
  ENST ID: ENST00000580888
  CDS Start-End: 61-213
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggat

SEQ ID NO: 131287 - DNA, 951 bp, Homo sapiens
  Payload ID: 5624
  Gene Symbol: EIF4A1
  Gene Name: eukaryotic translation initiation factor 4A1
  ENST ID: ENST00000583389
  CDS Start-End: 1-691
ggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaag

SEQ ID NO: 131288 - DNA, 447 bp, Homo sapiens
  Payload ID: 5624
  Gene Symbol: EIF4A1
  Gene Name: eukaryotic translation initiation factor 4A1
  ENST ID: ENST00000581770
  CDS Start-End: 193-447
agatccagtcacttcgtcgcggctaaaacacgggtcggggagaagaaaccggccgttcagtgtgctggttttcttgacggccaggactgagcctaaccccgaggagcggccgcgtgaggcaccaggagcccacccggcgccgggcgggcgggtccattttgccgcacaagccgggctattggcaaactgcggatgggcaggtccaccttccttcggggatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggcc

SEQ ID NO: 131289 - DNA, 1645 bp, Homo sapiens
  Payload ID: 5624
  Gene Symbol: EIF4A1
  Gene Name: eukaryotic translation initiation factor 4A1
  ENST ID: ENST00000582746
  CDS Start-End: 1-1026
atgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaa

SEQ ID NO: 131290 - DNA, 1109 bp, Homo sapiens
  Payload ID: 5624
  Gene Symbol: EIF4A1
  Gene Name: eukaryotic translation initiation factor 4A1
  ENST ID: ENST00000584860
  CDS Start-End: 339-1109
tgtgccgggggagggacggcgcgcggggttccggagcattctgacggtaccactcgcgagaggcgggggtgcctggtccttagatccagtcacttcgtcgcggctaaaacacgggtcggggagaagaaaccggccgttcagtgtgctggttttcttgacggccaggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgagatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacc

SEQ ID NO: 131291 - DNA, 547 bp, Homo sapiens
  Payload ID: 5624
  Gene Symbol: EIF4A1
  Gene Name: eukaryotic translation initiation factor 4A1
  ENST ID: ENST00000578754
  CDS Start-End: 197-547
ctagtttctaaggatcatgtctgcgagccaggattcccggttatgatgtgattgctcaagcccaatctgggactgggaaaacggccacatttgccatatcgattctgcagcagattgaattagatctaaaagccacccaggccttggtcctagcacccactcgagaattggctcagcagcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgct

SEQ ID NO: 131292 - DNA, 552 bp, Homo sapiens
  Payload ID: 5624
  Gene Symbol: EIF4A1
  Gene Name: eukaryotic translation initiation factor 4A1
  ENST ID: ENST00000582169
  CDS Start-End: 149-552
ctagtttctaaggatcatgtctgcgagccaggattcccgatccagagacaatggccccgatgggatggagcccgaaggcgtcatcgagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacct

SEQ ID NO: 131293 - DNA, 818 bp, Homo sapiens
  Payload ID: 5624
  Gene Symbol: EIF4A1
  Gene Name: eukaryotic translation initiation factor 4A1
  ENST ID: ENST00000584784
  CDS Start-End: 5-818
gatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgcca

SEQ ID NO: 131294 - DNA, 576 bp, Homo sapiens
  Payload ID: 5624
  Gene Symbol: EIF4A1
  Gene Name: eukaryotic translation initiation factor 4A1
  ENST ID: ENST00000582050
  CDS Start-End: 1-207
atcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgagtgtcctccgtgcacatgctgaagagttgtctttcttgacgtaggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaa

SEQ ID NO: 131295 - DNA, 1319 bp, Homo sapiens
  Payload ID: 5624
  Gene Symbol: EIF4A1
  Gene Name: eukaryotic translation initiation factor 4A1
  Uniprot ID: P60842
  ENST ID: ENST00000577269
  CDS Start-End: 6-1049
ggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaa

SEQ ID NO: 131296 - DNA, 563 bp, Homo sapiens
  Payload ID: 5624
  Gene Symbol: EIF4A1
  Gene Name: eukaryotic translation initiation factor 4A1
  ENST ID: ENST00000583802
  CDS Start-End: 74-563
agtttctaaggatcatgtctgcgagccaggattcccgagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatat

SEQ ID NO: 131297 - DNA, 1444 bp, Homo sapiens
  Payload ID: 5624
  Gene Symbol: EIF4A1
  Gene Name: eukaryotic translation initiation factor 4A1
  ENST ID: ENST00000581544
  CDS Start-End: 15-302
agtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaaggatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaa

SEQ ID NO: 131298 - DNA, 642 bp, Homo sapiens
  Payload ID: 5624
  Gene Symbol: EIF4A1
  Gene Name: eukaryotic translation initiation factor 4A1
  ENST ID: ENST00000581384
  CDS Start-End: 1-642
cggcttgggctcattgtgcgcgaggccgccaccgcccgcggcctcccacatccggatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctca

SEQ ID NO: 131299 - DNA, 573 bp, Homo sapiens
  Payload ID: 5624
  Gene Symbol: EIF4A1
  Gene Name: eukaryotic translation initiation factor 4A1
  ENST ID: ENST00000578476
  CDS Start-End: 17-241
ctagtttctaaggatcatgtctgcgagccaggattcccggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgagatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggg

SEQ ID NO: 131300 - DNA, 909 bp, Homo sapiens
  Payload ID: 5624
  Gene Symbol: EIF4A1
  Gene Name: eukaryotic translation initiation factor 4A1
  ENST ID: ENST00000580461
  CDS Start-End: 17-241
ctagtttctaaggatcatgtctgcgagccaggattcccggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgagatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggac

SEQ ID NO: 131301 - DNA, 916 bp, Homo sapiens
  Payload ID: 5624
  Gene Symbol: EIF4A1
  Gene Name: eukaryotic translation initiation factor 4A1
  ENST ID: ENST00000578495
  CDS Start-End: 17-916
ctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatg

SEQ ID NO: 131302 - DNA, 1919 bp, Homo sapiens
  Payload ID: 5625
  Gene Symbol: EIF4A2
  Gene Name: eukaryotic translation initiation factor 4A2
  Uniprot ID: Q14240
  ENST ID: ENST00000323963
  CDS Start-End: 65-1288
tataaaaaacgggtggttgggcgccgctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggt

SEQ ID NO: 131303 - DNA, 1005 bp, Homo sapiens
  Payload ID: 5625
  Gene Symbol: EIF4A2
  Gene Name: eukaryotic translation initiation factor 4A2
  ENST ID: ENST00000429589
  CDS Start-End: 35-325
cttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctggtttattaatttgcagcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggt

SEQ ID NO: 131304 - DNA, 1751 bp, Homo sapiens
  Payload ID: 5625
  Gene Symbol: EIF4A2
  Gene Name: eukaryotic translation initiation factor 4A2
  ENST ID: ENST00000426808
  CDS Start-End: 40-330
gctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaa

SEQ ID NO: 131305 - DNA, 1889 bp, Homo sapiens
  Payload ID: 5625
  Gene Symbol: EIF4A2
  Gene Name: eukaryotic translation initiation factor 4A2
  Uniprot ID: Q14240
  ENST ID: ENST00000440191
  CDS Start-End: 35-1261
cttttcagtcgggcgctgagtggtttttcggatcatgtctggtggctccgcggattataacagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaa

SEQ ID NO: 131306 - DNA, 1729 bp, Homo sapiens
  Payload ID: 5625
  Gene Symbol: EIF4A2
  Gene Name: eukaryotic translation initiation factor 4A2
  ENST ID: ENST00000443963
  CDS Start-End: 15-308
tggtttttcggatcatgtctggtggctccgcggattataacagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaa

SEQ ID NO: 131307 - DNA, 480 bp, Homo sapiens
  Payload ID: 5625
  Gene Symbol: EIF4A2
  Gene Name: eukaryotic translation initiation factor 4A2
  ENST ID: ENST00000441007
  CDS Start-End: 310-480
gaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttcc

SEQ ID NO: 131308 - DNA, 1977 bp, Homo sapiens
  Payload ID: 5625
  Gene Symbol: EIF4A2
  Gene Name: eukaryotic translation initiation factor 4A2
  ENST ID: ENST00000425053
  CDS Start-End: 35-1123
cttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacaggagtcgatagcagcagttggtgacgagatggcactcagaaacggcgttgacgtaatttaggacgtggaatcataagcgaaacagcacactgtttgaataaagagcgaaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaatt

SEQ ID NO: 131309 - DNA, 600 bp, Homo sapiens
  Payload ID: 5625
  Gene Symbol: EIF4A2
  Gene Name: eukaryotic translation initiation factor 4A2
  ENST ID: ENST00000445596
  CDS Start-End: 307-600
aaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgag

SEQ ID NO: 131310 - DNA, 579 bp, Homo sapiens
  Payload ID: 5625
  Gene Symbol: EIF4A2
  Gene Name: eukaryotic translation initiation factor 4A2
  ENST ID: ENST00000498746
  CDS Start-End: 252-579
agttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagact

SEQ ID NO: 131311 - DNA, 1734 bp, Homo sapiens
  Payload ID: 5626
  Gene Symbol: EIF4A3
  Gene Name: eukaryotic translation initiation factor 4A3
  Uniprot ID: P38919
  ENST ID: ENST00000269349
  CDS Start-End: 223-1458
acgcacgcacgtctctcgctttcgcatacttaaggcgtctgttctcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaactta

SEQ ID NO: 131312 - DNA, 553 bp, Homo sapiens
  Payload ID: 5626
  Gene Symbol: EIF4A3
  Gene Name: eukaryotic translation initiation factor 4A3
  ENST ID: ENST00000576547
  CDS Start-End: 179-553
tcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggggctgcttgctctcggtgactacatgaatgtccagtgccatgcctgcattggaggcaccaatgtt

SEQ ID NO: 131313 - DNA, 4148 bp, Homo sapiens
  Payload ID: 5627
  Gene Symbol: EIF4B
  Gene Name: eukaryotic translation initiation factor 4B
  Uniprot ID: P23588
  ENST ID: ENST00000262056
  CDS Start-End: 327-2162
tcttccggcaggaagtctgtgcgtcaggaggccggccaggactcagctccagccccgcgctcgcgtgtagccctacgtaaagcgtgaggggtttcgcgacaacccaggccccgcccctttggccacatgtcgcgcatgtcttcccgtcggacggcgtgccacctcgccgcgcagctttacgaacctagagcagcgccgccccgcctcctgtctccgtcctcacctccccgccccctcccagcttcgcgtctcctagctcgacgcgcccgctataatcacgtgattgcctcatccgggtcttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggcgacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttca

SEQ ID NO: 131314 - DNA, 1936 bp, Homo sapiens
  Payload ID: 5627
  Gene Symbol: EIF4B
  Gene Name: eukaryotic translation initiation factor 4B
  ENST ID: ENST00000420463
  CDS Start-End: 29-1879
cttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaagtaagtcagaccaggatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggcgacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagc

SEQ ID NO: 131315 - DNA, 1985 bp, Homo sapiens
  Payload ID: 5627
  Gene Symbol: EIF4B
  Gene Name: eukaryotic translation initiation factor 4B
  Uniprot ID: P23588
  ENST ID: ENST00000416762
  CDS Start-End: 28-1746
ttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaattctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggcgacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagagg

SEQ ID NO: 131316 - DNA, 537 bp, Homo sapiens
  Payload ID: 5627
  Gene Symbol: EIF4B
  Gene Name: eukaryotic translation initiation factor 4B
  ENST ID: ENST00000551002
  CDS Start-End: 29-537
cttttgcgttctctttccctctcccaacatggcggcctcagtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagagg

SEQ ID NO: 131317 - DNA, 1476 bp, Homo sapiens
  Payload ID: 5627
  Gene Symbol: EIF4B
  Gene Name: eukaryotic translation initiation factor 4B
  ENST ID: ENST00000550704
  CDS Start-End: 26-709
ttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacagaagaaatggctcttgaaagaaaaagcagacaatcagaccaagggtcctgttttgagtccaggggcatgacttttctcacctgaaaccttgaatttagagcaagcagaatggataacgaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaag

SEQ ID NO: 131318 - DNA, 885 bp, Homo sapiens
  Payload ID: 5627
  Gene Symbol: EIF4B
  Gene Name: eukaryotic translation initiation factor 4B
  ENST ID: ENST00000549077
  CDS Start-End: 54-581
aatcacgtgattgcctcatccgggtcttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtgcttctgctatgcccagacgttcaaggtcactcaagggatttgtgcataatggggcaaaaggttggttaatatggtcctatgctctcagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccggg

SEQ ID NO: 131319 - DNA, 871 bp, Homo sapiens
  Payload ID: 5627
  Gene Symbol: EIF4B
  Gene Name: eukaryotic translation initiation factor 4B
  ENST ID: ENST00000550390
  CDS Start-End: 1-558
atggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagggactcctggcccatacagaatttgagatagctaagcattaaaccaataggaaaaaacgggaggaaaagagccacctggggttgaattggagcatgtacttatggggcctgagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatgg

SEQ ID NO: 131320 - DNA, 1097 bp, Homo sapiens
  Payload ID: 5627
  Gene Symbol: EIF4B
  Gene Name: eukaryotic translation initiation factor 4B
  ENST ID: ENST00000549481
  CDS Start-End: 17-1097
ctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaa

SEQ ID NO: 131321 - DNA, 841 bp, Homo sapiens
  Payload ID: 5627
  Gene Symbol: EIF4B
  Gene Name: eukaryotic translation initiation factor 4B
  ENST ID: ENST00000552490
  CDS Start-End: 16-841
tttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacagctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattata

SEQ ID NO: 131322 - DNA, 1097 bp, Homo sapiens
  Payload ID: 5628
  Gene Symbol: EIF4E
  Gene Name: eukaryotic translation initiation factor 4E
  Uniprot ID: P06730
  ENST ID: ENST00000280892
  CDS Start-End: 121-834
gagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgaggcggcgtgtagcgcacactttctggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctgg

SEQ ID NO: 131323 - DNA, 11523 bp, Homo sapiens
  Payload ID: 5628
  Gene Symbol: EIF4E
  Gene Name: eukaryotic translation initiation factor 4E
  Uniprot ID: P06730
  ENST ID: ENST00000450253
  CDS Start-End: 1526-2179
aggcacaggcagcctgcatacactccttttcctggtgtcaacattatttaaaagcatgggaaatagtaatgagacagtgtcttcttcattagaaccttaggagtctactagatttcttcatctctatttgttgttattagtagccaaactgtgcaaaaaacacggtcttgagaaatgacagcacagtatcttagagggaaaggaaatgtaggatgccagtgtggggacaaatttctgattgccagtgattgttgtgagcataacaataatttcatgaacattaaagcctctattgagggcagctgcagttgtaaaggaaaaaaaatggtcctgaacatttaaaactacactggtgtacatcataatcaaacaaagtaaacagaaaaaaatttaaactttgctaaaaaaaaaaagcagaagcacttgatctttaggaaggcacgcagttgcttattatgaatcatttctagagtccgatgcattttcaaagccggttacagtcattacgaagcacacccttgtgaggtaagtgtatcatcacctttggttcataaataaaaaagctgagacgccgagcgattaagtcactcgcctaaggagaatgagtcaacgtcaagagtcatagttgacccggcctaaagactccagaccatcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaaaaaaaaaaaaaaaaaaggtgggggagagactccacttcccagaagcctctcgttactcacgcagccgcagtcttgcgcaggtgccgccagggccaaacggacatatccgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaattggttaaggtgacttactgtctatgtcaatatgtatagttttgagtacttcaagagtttacttaaaagtgatgatgttactggtatgttggcagtgggtgggactgaagtagtgtatctattataaattgatctattttcttaattctaagatgaagtccaattttaagcatcagcttttaggtgcaaaggaggaattaacacattaaatgtatacagttctaaatttttgaaataactgatgtgtagcatttgattattggtattaccattttagaatcatgatgttattttaaacctttttcctggggacaagaaaggataataaattacgctgaatcacttttggcagttgccacttaaatagtacagtgacttgcaacttttataactttatcagcatcttctctaaatacaaaattaggctatatgttattttccaacttactgttttctctctgtttagcaggatattataaatagattaaatagatatattttctttttttttttttttttttgagacggagtctcgctttgtctcccaggctggagtgcagtggcgtgatctcccagtagctgggactacaagcacctgccaccatgcccggctaattttttttgtatttttagtagagacggggtttcactgtgttagccaagatggtctcaatctcctgactttgtgatctgcctgcttctgcctcccaaagtgctgggattacaggtgtgagccaccgtacccagcccaaatagatgtattttcataatagagaattgaaataggctttaatgggtgaatagcagtttattgtaggcatgtgacatttcatttaatgaatttaaagtttattatcccaattctacagaaggatttaatgcatactatgcaattaaataattataacactacatagtaataatttatgtgccaggcagtagttcagtcactttacatgcttattaacctgcagaataatcttttgagatgtaggtgctgttactgagaatttaacttttgcttgtaaattgcaaagggtggatttgaattctggaaatttggttccagagacaataattacataacactttctccatagggtacagcctgtctaataggctatagtaaatcacctcagcttgttataggtcgggcatgcaaacatttctccattttactccctttggtaatgaatctagtaatagatggaaattttccctagattcactgtgttagtcagttggggaagtttggaggcaaagatacaggagtttatggggaggtagtgtacataaatataatcatatgctatataaggaagttttggtcagcagcagaccatatataggatggtgggccagtaacattgtaacactgtatttttactgtatcttttccatgttttgttatgtttagatacacaaataacattatggagtattcagtatggtaacatgccatacaggtttgtagcctaggagcagtaatagactgttccctgaaacctatatttgtggtaggtttataccattcaggtttgtgtaagtacacaacgaaatcatctaatggcccatttctcaaaacatattcccatcattaatcaatgcatggtcatgttttcgtatacattttaagcttctgtattctaatctaatataaatggcaaaatattcaaactgataggcattgagattcttaaatgctaaagttgcattcaaaaggataattttaggcgttgtgacaaagcagtgttatattttaaagttagtgacaaggctatgcaccttttatctctaattgtttcttacagaatgtttttattattgagtagtaaaacaataaatgtcagatcctttatacaaattcaagattgacattgataaacaaaacttcagcatatcactcaaggtcagcgtagaaattgtgtgtctggaaacttctatagtaattttatattactgtgacattagtatgtgatcacttttctagtaatgttttaaaaaaatatatcttacaggccaggcatagtgctttatgcctgtaatcccagcactttgggaggccaaggtggcaggattgcatgagtccaggagttcaacaccagtctgggcaataaagtgagaccccatcgctacaaacaaattaaaaaatatttatgtatgtgtgtaatatatataatatataacaaaacacatatgtatgtgtatatatagtatgtctggcagagtacaatttaggggttaagactggtccctcacatatggtgtgagaaacactgttcacaggttgctttccccattagcccagggcaactcatttgcccatcatttcctagaacaaccgggtctgttacgtctacagttttcatcttcatgcagttatggatttggtgtcaaaaactttggtcctgttctctaccatcttaaaataaactcttgtgtcctgctttactatgaattgcaaagtaggcattaggtagccttcctactaccatagtttagagttcaatattcttatgaccattctactggtagaagcaaaaaatgaacttgtaggcatgtgatcacatgtgcctatggtgctgtcttttccagtacaggggaactaattttcatattttaatcttgcagctttttgtttacttcatgcattgtgatttctcatagttttgcacagaactcacttccctaccttttctgaaacaaaagtatgtatacacacatacatatgtattgagcacctctatttactgtgttccacgtgctgggcatatagcaagaacagaatggtctggggccctgctctaaagaagatttaaaagcaaacatatattaaaaatgcgtgagtctggccaggagcagtggctcatgcctgcaaccccagcactttgggaggctgaagcgggtgaatcacctgagatcaggagttgagaccagcctggccaacatggtgaaaccccgtctctactaaaaatacaaaaattagcctggcatggtggcatgcgcctgtaattccagctactttggagactgagacaggagaatcacttgagcccaggaagtggaggttgcagtgagctgagatcgcgccactgcactccagcctgggtgacagagcaagactccatctcaaaaaaaaaaaaaaaacgtgtctgttcataaggttctacaaatagctgttgttacagaaaataggactagggttttattactggggattatgcagtcgaggtaaatataaaatgaggttgtttcttcttttttttatttgagacagagtcttgtttgccaggctggagtgcagtggcgtgctcttagctccgcctcccgggatcaaacgattctcttgcctcagcctctcgagtagctgggactacaggcgcgtgccaccacacccagctgatttttgtatttttagtagagatgggatttcaccatgatggccaggatggtctcgatcttttgacctcatgatccacccacctcggcctcccaaagtgctgggattacaggcgtgagccactgcacccggccctggttctaaatactcttccagctctaaaacattgattctaaacagatcacattccaggaggactctagcaaaccagcatatgcaaattatagcttttgcaagaccgtttctacttttatattactgaactctatatgattgtccaagtaaagttttgtgtctctttgattatttgattgtactttaaaattttttcaccattcatttaacattttttaccatactgtagtatttttaatgcaattgtgtttgcattggtgtggctttagaggcttctccaaccaccttcccaaaatactgatctgtgatttttttctttaatgtttggccaaacataatacatgcttattttatttttcatccctacagaaaggtagaagatgagaattctgtctcctactgttgtttttcaaggtgccactcaaatttcttgtacgtgtctagaaacttgtgcatacaatagaagtacactgtggctgggcatggtggctcatgcctgtaatcccagcactttgtgaagctgaggtgggtggatcacctgaggtcagggagtttgagaccagcctggccaacatgatgaaaccccgtctttactaaaattagaaaaaattagccaggcgtggtggtgtgcgcctgtaatcccagctactcgggaggctgaggcatgagaatcacttgaactcgggtggcagaggctgcagtgagctgagatcatgccactgcattccagcctgcgcagctgagccagactccatctccaaaaaaaaaaaaaaaaaaaaaaaaagatgtccaatatatgtaacttttttctttggacacaaaaattccattagctttgttttctcatttttacttgtcatgatgtatgtcgaacacattatttttagtgtctggtgttccattatacagatgtctctcttgttggttgaatttttgcattcacagaccctcaagttggattcatatctttttacactaagcataaagaagacggattggggtcgggtatggtggctcacgcctgtaatcccagcacttcgggaggctgaggtgggcggatcacgaggtcaggagttcgagaccagcctggccaacatactgaaaccccgtctctaaaaatatgaaaaaaaaattagccaggcgtggtggtgcgcagctgtagccccagctacttgggaggctgaggcaggagaatcacttgaacccaggaggtggaggttgcagtgagcatattgcaccattgcattccagcctgcacgacagaggaagacgccatttcaaaaaaaaaaaaaaaaagacggattgattttcttcagcagtatcaagtggcacttaccatccacccctttaacacccaaaccattctaatccatgtatacagaccatcatctgtttcgttattgtgttctataatgcagctttgcgagttatgcagttttggtcctcatgatatttttctgattggtttttaatgtattttgttctaacgagccaacattgttatacatgtaatttgtttatttgctagattgtactctttcccaaagatgggctatgaactagcatctactttcattttacctatttacctgtaaacattgaaaaaactgaatcaaatgcagtgatatcggacctagttttattgttatgccttataatgaatttaacttcacagttttctaaatgagagcatttcccaaagacatctttatggtcataaccagtttcccttggcatttgatttatttttatttttatttatttatctttttgagaaggagtttcgctcttgttgcccaggctagagtgcaatggcgtgatctcgggtcactgcaacctctgcctcccgggttcaagcgattctcctgcctcagcctccaagtagctgggattacaggcatgcaccaccacgcccgactaatttgtatttttagagacggggtttctccgtgttggtcaggctggtctcaaacttccaacctcaggtgatccgcccgccgtggcctcccaaagtgttgggattacaggcgtgagccacagtgtctggcctgatttgtttttaagagcattatttttctgctttattttgtgacttcaacatttgacacaattttgggtgaatggtttgtgcatggtgcctgacatcgtgttttgatgtgtagtatatgccataggacatgtgagacaagatatgtcccaacttgaccttgttttgtattgtttatgtcaaggtgttgagtgtattagatatactgttggggctctgtgttctagctctgccttttagataataaccatggttaaatattgcaatgtcctgcatgtctccacacatgggttttgtaactgagtcagaatgataagtgattagtaagcacattttttctcctttcaggaaaccactattttccttttctacatgctgttttgtaagtagtacttttatgaaggttgtcttcaaatgttcgcatcttccatttctactgcccttgggttatccatcctgtcattttgtgccaatcacttttttttttaacttttaagttcagggatgaaagtgtagatttgttacataggtaaacttgtgtcatggggttgttgtacagattatttcatcacccaggtgttaagcctagtatgcactagttgtttttcctgatcctctccctgctcccaccctccaccctctgataggccccagtgtgtgttgttcccctctgtgtgtccatgtgttctcatcatttagctcccacttacaagtgagaatgtggtgtttggttttctgttcctgcattagtttgctaaggataatggcctcgagctccatccaagtccctgtaaaggacatgatcttgtacttttttatggctgcatagtattctgtggtgtatatgtaccacattttctttatccagtctatcattaggcatttaggttgattccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaccaaatagcttaccctctttaaatttcccttttacttcttacaaactcctaacaccatttacgactttgtcatcaatatggtcaactaagcttggtttgcatggctctacttcctttcaccttccacttaggcagtgtctccaagtccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgta

SEQ ID NO: 131324 - DNA, 686 bp, Homo sapiens
  Payload ID: 5628
  Gene Symbol: EIF4E
  Gene Name: eukaryotic translation initiation factor 4E
  ENST ID: ENST00000511644
  CDS Start-End: 1-466
cgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacagagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttt

SEQ ID NO: 131325 - DNA, 1132 bp, Homo sapiens
  Payload ID: 5628
  Gene Symbol: EIF4E
  Gene Name: eukaryotic translation initiation factor 4E
  ENST ID: ENST00000504432
  CDS Start-End: 212-949
agatcgatctaagatggcgactgtcgaaccgggtgctgtgaggaaatgcatggtttgttgaaaagaactgaggactgacagccgcctcctccatgattaccctggctctctgtcccacccttctcatggcgcttgggggaccatggctgatcctgtcctgagacaaattaagactcctgtggtgaagcagttggtcgagaaaaagtgatgcatgaaaaagaagcaaaacaagaaggaaagaaaaaaaatgagagctgaagatggtgaaaatgatgccattaaaaagcaggcagaaagtctgcgagaatcccaggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttt

SEQ ID NO: 131326 - DNA, 898 bp, Homo sapiens
  Payload ID: 5628
  Gene Symbol: EIF4E
  Gene Name: eukaryotic translation initiation factor 4E
  Uniprot ID: P06730
  ENST ID: ENST00000505992
  CDS Start-End: 22-768
gtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacaagatgggatcttgctatgttgcccaggttggtctcaaacttctggcctcaagtgatcctcccacttcagcctcccaaagtgctggaattacagcttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcaga

SEQ ID NO: 131327 - DNA, 738 bp, Homo sapiens
  Payload ID: 5628
  Gene Symbol: EIF4E
  Gene Name: eukaryotic translation initiation factor 4E
  ENST ID: ENST00000515638
  CDS Start-End: 14-142
agatcgatctaagatggcgactgtcgaaccggaaaccacccctactcctaatcccccgactacagaagaggagaaaacggaatctaatcaggaggttgctaacccagaacactatattaaacatcccctacagaacagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtg

SEQ ID NO: 131328 - DNA, 1020 bp, Homo sapiens
  Payload ID: 5629
  Gene Symbol: EIF4EBP1
  Gene Name: eukaryotic translation initiation factor 4E binding protein 1
  Uniprot ID: Q13541
  ENST ID: ENST00000338825
  CDS Start-End: 234-590
gtgcggaagagcccgtgagcagacgggagtgggtcggggggcggcgggggatcccacgtggaagcagcgtcctggagctgggtggggctgcggcgcggactacaaatcccaggggcgtggggcgggagaggcggaaggggcgtcctggggcggggcggcacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaaga

SEQ ID NO: 131329 - DNA, 7257 bp, Homo sapiens
  Payload ID: 5630
  Gene Symbol: EIF4EBP2
  Gene Name: eukaryotic translation initiation factor 4E binding protein 2
  Uniprot ID: Q13542
  ENST ID: ENST00000373218
  CDS Start-End: 24-386
gccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatgtctcaggaataagctggatctccaatgttttggggatgctttgagtctcaaaaaaaattgataatcagaaaagtaatttttgtttgtttgtttaatgtatccctgttctgtttttaattaaactccaagtctcattttacatattcttggaaaaacctaagttgctctgtaatttacataagaagcatgctcaggacctctttgtaccccggggagcctgattctttgggaatgaagcttttcattcttcatacactggccttggcatcctgtggaatttgacccaactagcagctagtcagtctgtcagtgagcagaagagtgaactcttcttgatctttattgctatgtgtgaaaacttggcttcctcactgaacggtgaggaatggatttaaagcatgagctttagtagtatcaagatgccattttcctttttcttgctgtcttggggagcttctgcatgtgaccccctaatcagaaggcatgtttttagtatttcttgggagtgtcagctgtataatgcagcagctgttcaatcccttacccttctctgcaaggacttccttacagcttggtgcagttctttcccagaggccaccactactagacagtctttcttttatcttatggagataaattggcatttaaaaaataatttcacaaggcatgagataaactttcaatagatgatacctttgtgtcatgcctcatggaattatttttagaacaagccagagtccattgagtggtttacctctgcatgtttggagggaacctcacagatgaaacccttaatgaataatgtgtccggggttttttagagagaaggagcactcttaagttaccactttgagacagctcttaacatcttagtgaccatttgtagttttctttttatgaggaacccatgcttctatacttgggcggacaatcgagcttaatgagaagtgacttcccttcaaattccaacagcagacatgcattgtcatgattctgtcttctttttagtgtggtttattgagttcagcagttctcatattctgtttaaataggtacagcattttcaagggcacagatacagagaagctggctttctaggtattgggcttccaagccaagagttttgtccttccacctgtattagttatctattgctgtgtaaaaaattaccctaaatttagtatgttaaaatagtaaacattatctgtcagtttctgtgggttaagaatttgggagtagtttaacatgatggttctggcccatggtatcatgaagttacagtcaagattgaacaggggctgcagtcagctggagctggagaaaccacttccaagttctctctttgtggccgttggcaggatgcctcagtttcttcccatgtgggtctctgcgtagggcagcatgagtgtcctcacaccatgacacctggcttctccctgagcagctgattccagagatcatggggcagggccaggagaaagctgcagtgccttttaagacatagtcttggaaaggacacaccgtcacttcttatcctagttgttagaagcaagccactaagttcagcctgcactcaaggagagaggaattacacatacctctaccccaatggagcagtagcaaagaatttatggacatatcttaaaagcaccacaccccaactggggatgaaagtaggtcaacagggaggtaggtttaatctagataagctgaaagatagattgctatcaaaaacagttctccaagatgtgcatagccaaactgggatagaaggcaaactccccaaagctacctgctggttttgagaggggtggtaagacatggcaattcccaggagtagtagaaaataatatgcctgactaccaacagctcaagtatgcttatttgcacatcctagacttggtgtctgtaagactcagttaccacttttattttcctgtagctaggagttagcaaaaggaactggggccttccagccgagccactaaacctgtcttatttggaatggggattgtccagcaaagggagcaaacatgaattagatgttaagctattgagctgaagaaaagaaagcagttcacatttaggtgaaatagatgatgttatcaggaagccaggttcccaccagagtcggtgcttggtacctggtctctccagtctcaacagactcaggtcaggtctctcacccaggaagcaaccactcaataaaatagagaacatctgagaattacaaatgtctatgcttgattgctcctctaaatccagtgcataggttaaccctgcatgcccatttcttcctgggcttcttgatggcaatgtgttcttaaataactggtcttgtgttcatgctaaagacaaacttacatgaagtttttcagtttaagacattctagtgaatggctgctatgtgtttctggcactcattcctaaccaagtctttagagatttcagatgaccttaaagatgcaatatctttttctttctttctttctttctttttttctgagacaagagttgcgccctgtcgcccaggctggggtgctggagtgcagtggtgcgatctcagctcactgcagcctctgcttcccaggttcaagtgtttctcctgcctcagccttccgagtagctgggattacaggcatgtaccactatgcctggctaatttttatttctatatttttagtagagatggggtttcatcatgtttgccaggctggtctcgaactcctggcctcaagtgatccgcccacctcagcctcccaaagtgctgggattacaggcgcgagccaccgcgcctggccaaagatgcaaattcttgtttggatttatgctctgcctcttcccagcattttcttatctgtagccctgcttgcttgagagtatacttggataagaagtattgctgttgagggagctataagaaaaggattcttcttccagaagtaaagaactcatctttagagtacctttaaatgaattttgtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccagaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagcagatgtttggaaattaaggaaaaaattaaattctcatcaatggttgctgttatagttaaatcagtaaagatcttgagtatcaa

SEQ ID NO: 131330 - DNA, 691 bp, Homo sapiens
  Payload ID: 5631
  Gene Symbol: EIF4EBP3
  Gene Name: eukaryotic translation initiation factor 4E binding protein 3
  Uniprot ID: O60516
  ENST ID: ENST00000310331
  CDS Start-End: 73-375
ccgcctcagactcagagctgcgctcctcgacctcaacgccaggcggttactttgctgctcctcccgctcgctatgtcaacgtccactagctgcccgattcccgggggccgggaccagctgcccgactgctacagcaccacgccggggggcacgctatacgccactacccccggaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 131331 - DNA, 1974 bp, Homo sapiens
  Payload ID: 5632
  Gene Symbol: EIF4E1B
  Gene Name: eukaryotic translation initiation factor 4E family member 1B
  Uniprot ID: A6NMX2
  ENST ID: ENST00000318682
  CDS Start-End: 585-1313
gttgggagttgagggagggggacaacgcggcgtgtgaagagtggggaagaaatcacgcgactggatttggagttctgctgggctcgaatctcagctgtgctttttattaaccgtgggaccttgagctactcggctctcctttctgaatgacagtttcctcctctgtaaaacaggaatggttaattcaacgaatgtttactgagcgcttagtccagtggtgcaggtttaaggctggaggcagcggaaaaggaaaacaaggttcctggtctcgggaagcttaccatgggggtgtctgtacgcgtgtgtgttcgtgcgctcagtggtggaagacaggacagaaaataaacggatcaacatccaaagcaacaaggtcattacagcttatggggaaactgactcgatgaagctcaggcctggccgcggtcagggtagaatcaggactagaacccaggctgtgtggctgcagccctgaccctcaccatccaggtcaggcagagaacactcaggtcttggcccccatggtgtggggcttggtcacagctgcttccccagccccaggcctgcacgaagaaggcactcactaaatgcttgctgttgaggtgagtgaagctgagggtggaatccgagagtgggaggaggaggagaaggaggaggaggcagcagagaggacgcccacaggagaaaagtctccaaactctcccaggactttgctgtctctgagagggaaggcccggacggggggccccatggaagtcaagctggagctgcaccccttgcagaacaggtgggctctgtggttcttcaagaatgaccgcagccgggcctggcaggacaacctgcacctggtcaccaaggtggacactgtggaggacttctgggcgctatacagtcacatccagctggccagcaagctctcctctggctgtgactacgccctcttcaaggatggcatccagcccatgtgggaggacagcaggaataaacggggtggccgctggctggtcagcctggccaagcagcagcgccacattgagctggaccggctgtggctggagacgctgctgtgtctgatcggggagagctttgaggaacacagcagagaggtatgtggggccgtcgtcaacatccgcaccaagggggacaagatcgctgtgtggacgagggaggcggaaaaccaggcgggcgtgctgcacgttgggcgtgtatacaaagagcgcctgggcctctccccaaagaccatcattgggtaccaggcccatgcagacacagccaccaagagcaactccctagccaagaacaagtttgtggtgtgaggggggccttggcacccctcctatgtaatgggacagccgccactgagcctcattactttgggggatggggcgggactggggatcagacagcctagttcttacctgtcctcaagtgaacaggaatgcaaacactctttaacatgagttggggcctgagccttaggggctagatgggggtagtggtggcagtctgaggacctagcttgtcctggggccacaggacagcagcagggtggaaaaaactcctgagggtggggtgagtcatggcggggaaggagggctctatggtaggcggagaaacccatagtccagcgtttactgtttccacccaggaaggaggtgaggtggcctgagagacagactcttccatgggtggtgggctcaagggcacagacattctggagggtgaacgccatcatttgtacagagggatacgtgggttgctgaggactgagagagccttgcaaggccgctccccttctccccagctgtgaccagggctgtctgggccttgcctgcctcagggccagactgaagtggaggtggagggatgctgggctaggcctcaccaaggttctggtagaagtggtggaagtggataaacttgataataaaagcttaagcatctttctgttcctgttttaaataaatacttctgaac

SEQ ID NO: 131332 - DNA, 581 bp, Homo sapiens
  Payload ID: 5632
  Gene Symbol: EIF4E1B
  Gene Name: eukaryotic translation initiation factor 4E family member 1B
  ENST ID: ENST00000510660
  CDS Start-End: 312-581
aagcttaccatgggggtgtctgtacgcgtgtgtgttcgtgcgctcagtggtggaagacaggacagaaaataaacggatcaacatccaaagcaacaaggtcattacagcttatggggaaactgactcgatgaagctcaggcctggccgcggtcagggtagaatcaggactagaacccaggctgtgtggctgcagccctgaccctcaccatccaggtcaggcagagaacactcaggtcttggcccccatggtgtggggcttggtcacagctgcttccccagccccaggcctgcacgaagaaggcactcactaaatgcttgctgttgaggtgagtgaagctgagggtggaatccgagagtgggaggaggaggagaaggaggaggaggcagcagagaggacgcccacaggagaaaagtctccaaactctcccaggactttgctgtctctgagagggaaggcccggacggggggccccatggaagtcaagctggagctgcaccccttgcagaacaggtgggctctgtggttcttcaagaatgaccgcagccgggcctggcaggacaacctgcacctggtcaccaag

SEQ ID NO: 131333 - DNA, 514 bp, Homo sapiens
  Payload ID: 5632
  Gene Symbol: EIF4E1B
  Gene Name: eukaryotic translation initiation factor 4E family member 1B
  ENST ID: ENST00000505497
  CDS Start-End: 1-514
agctgcaccccttgcagaacaggtgggctctgtggttcttcaagaatgaccgcagccgggcctggcaggacaacctgcacctggtcaccaaggtggacactgtggaggacttctgggcgctatacagtcacatccagctggccagcaagctctcctctggctgtgactacgccctcttcaaggatggcatccagcccatgtgggaggacagcaggaataaacggggtggccgctggctggtcagcctggccaagcagcagcgccacattgagctggaccggctgtggctggagacgcagagaggtatgtggggccgtcgtcaacatccgcaccaagggggacaagatcgctgtgtggacgagggaggcggaaaaccaggcgggcgtgctgcacgttgggcgtgtatacaaagagcgcctgggcctctccccaaagaccatcattgggtaccaggcccatgcagacacagccaccaagagcaactccctagccaagaacaagtttgtggtgtgag

SEQ ID NO: 131334 - DNA, 1676 bp, Homo sapiens
  Payload ID: 5632
  Gene Symbol: EIF4E1B
  Gene Name: eukaryotic translation initiation factor 4E family member 1B
  Uniprot ID: A6NMX2
  ENST ID: ENST00000504597
  CDS Start-End: 321-1049
aaggctgtgggttgagcaaatactcagcctccagatggtcacgagccccccaagtgtgggggaggagcagggccttttatacgtctgggaccctaaaagtgcccaagatggggaaactgactcgatgaagctcaggcctggccgcggtcagggtagaatcaggactagaacccaggctgtgtggctgcagccctgaccctcaccatccaggtcaggcagagaacactcaggtggggcaggaggtcttggcccccatggtgtggggcttggtcacagctgcttccccagccccaggcctgcacgaagaaggcactcactaaatgcttgctgttgaggtgagtgaagctgagggtggaatccgagagtgggaggaggaggagaaggaggaggaggcagcagagaggacgcccacaggagaaaagtctccaaactctcccaggactttgctgtctctgagagggaaggcccggacggggggccccatggaagtcaagctggagctgcaccccttgcagaacaggtgggctctgtggttcttcaagaatgaccgcagccgggcctggcaggacaacctgcacctggtcaccaaggtggacactgtggaggacttctgggcgctatacagtcacatccagctggccagcaagctctcctctggctgtgactacgccctcttcaaggatggcatccagcccatgtgggaggacagcaggaataaacggggtggccgctggctggtcagcctggccaagcagcagcgccacattgagctggaccggctgtggctggagacgctgctgtgtctgatcggggagagctttgaggaacacagcagagaggtatgtggggccgtcgtcaacatccgcaccaagggggacaagatcgctgtgtggacgagggaggcggaaaaccaggcgggcgtgctgcacgttgggcgtgtatacaaagagcgcctgggcctctccccaaagaccatcattgggtaccaggcccatgcagacacagccaccaagagcaactccctagccaagaacaagtttgtggtgtgaggggggccttggcacccctcctatgtaatgggacagccgccactgagcctcattactttgggggatggggcgggactggggatcagacagcctagttcttacctgtcctcaagtgaacaggaatgcaaacactctttaacatgagttggggcctgagccttaggggctagatgggggtagtggtggcagtctgaggacctagcttgtcctggggccacaggacagcagcagggtggaaaaaactcctgagggtggggtgagtcatggcggggaaggagggctctatggtaggcggagaaacccatagtccagcgtttactgtttccacccaggaaggaggtgaggtggcctgagagacagactcttccatgggtggtgggctcaagggcacagacattctggagggtgaacgccatcatttgtacagagggatacgtgggttgctgaggactgagagagccttgcaaggccgctccccttctccccagctgtgaccagggctgtctgggccttgcctgcctcagggccagactgaagtggaggtggagggatgctgggctaggcctcaccaaggttctggtagaagtggtggaagtggataaacttgataataaaagcttaagcatc

SEQ ID NO: 131335 - DNA, 1604 bp, Homo sapiens
  Payload ID: 5633
  Gene Symbol: EIF4E2
  Gene Name: eukaryotic translation initiation factor 4E family member 2
  Uniprot ID: O60573
  ENST ID: ENST00000258416
  CDS Start-End: 674-1411
tgacaatagcaacatcaaagatcactgatcatagatcaccataacagacacagaaatcatgaaaaagttttaaatattttgagaattaccaaaatgtaacacagagacaccaagtgagcacatgctgttggaaaaatggcgctgatacaattgctggactcagggctgccacaaaccctccatttgttttcagaatgccctatctgcgaagcgtaataaaacgaggtatgccatagtacagtggcgccgcgaccgacaaaggaaagcctccgggaggtcaaaagagataccagagagtgcgtcccgcactggaggaagaggaaggtttttaccaagcagcgagtccagagcccgcgccgtcaacgacgcggtgctgccttttttccgagccgctgcgggagggggccaggacacgctcccttaggagagcgggcgggtcacaaggacctggacagaggcagaactgaggccagcagccagctccgccgctgagtccagccctctgcgcagccgccctgagctggcgtcccgagatagccgcttccaaaccgggcctgcgcgccgacgttccgctgcgccccgcgcaaaaccggaagtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaacta

SEQ ID NO: 131336 - DNA, 797 bp, Homo sapiens
  Payload ID: 5633
  Gene Symbol: EIF4E2
  Gene Name: eukaryotic translation initiation factor 4E family member 2
  ENST ID: ENST00000409322
  CDS Start-End: 34-636
ccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaaca

SEQ ID NO: 131337 - DNA, 1014 bp, Homo sapiens
  Payload ID: 5633
  Gene Symbol: EIF4E2
  Gene Name: eukaryotic translation initiation factor 4E family member 2
  ENST ID: ENST00000409495
  CDS Start-End: 37-738
actccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaagtacgtgttggggggttatgggaggacgtgtccctaagcttagtataagtagatctgtagttgggcccagaggaatatggccggacaggagacttacttgtggagaagggacagaccaggccttccctctagggcttctggctacttgctgcagttctttgtcagcgaggctccctgccacctatactaccaggtgctttgtagcagagagagcccatctgcagaaacccagttgtactacctgggcttgcttaatttctacaggctgtcttgtctttcatatgctaaccactatcttaaaatgaaagacaag

SEQ ID NO: 131338 - DNA, 604 bp, Homo sapiens
  Payload ID: 5633
  Gene Symbol: EIF4E2
  Gene Name: eukaryotic translation initiation factor 4E family member 2
  ENST ID: ENST00000409394
  CDS Start-End: 22-591
ggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggacaattcaagctttcgaaatacaaaaatcacattgtgagagtacacaagct

SEQ ID NO: 131339 - DNA, 3448 bp, Homo sapiens
  Payload ID: 5633
  Gene Symbol: EIF4E2
  Gene Name: eukaryotic translation initiation factor 4E family member 2
  Uniprot ID: O60573
  ENST ID: ENST00000409098
  CDS Start-End: 43-747
gaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgattgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaa

SEQ ID NO: 131340 - DNA, 1372 bp, Homo sapiens
  Payload ID: 5633
  Gene Symbol: EIF4E2
  Gene Name: eukaryotic translation initiation factor 4E family member 2
  ENST ID: ENST00000409167
  CDS Start-End: 37-603
actccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaagtacgtgttggggggttatgggaggacgtgtccctaagcttagtataagtagatctgtagttgggcccagaggaatatggccggacaggagacttacttgtggagaagggacagaccaggccttccctctagggcttctggctacttgctgcagttctttgtcagcgaggctccctgccacctatactaccaggtgctttgtagcagagagagcccatctgcagaaacccagttgtactacctgggcttgcttaatttctacaggctgtcttgtctttcatatgctaaccactatcttaaaatgaaagacaagtgcttttctttttcttgctgttttttaagataatttcaccctgcccaccctcaccccacttctgcatgtctttttaacttgttagcttcagtctattttctttgtcctgggatactgactacttatcaggaatgactccatttccttgtgtatagagctgactcttagaagaagggggatagtgtgtgtgtgagagagcagaatcaaagggaagcatgaaggccacagggaaaataagcttggcaatctccctaggactcagggaaatagagctctctgtccacagtgagaatcactgttaggcttgctcctcagtgattgagtgtcagaagtaagctcaggctattgtgaaaaagtgtggggagtggctgtcagattgtctcaaagctggagggagagctagccagctaagagttaggactcttaggtttagttctctcatatggccccataccaatatgtgcctttgacaagtgtctttgcaactttgctt

SEQ ID NO: 131341 - DNA, 3525 bp, Homo sapiens
  Payload ID: 5633
  Gene Symbol: EIF4E2
  Gene Name: eukaryotic translation initiation factor 4E family member 2
  ENST ID: ENST00000409514
  CDS Start-End: 43-753
gaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccgacagcatcaaggcctgggaggagtttcatggcctggtgaacagcagcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgattgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaag

SEQ ID NO: 131342 - DNA, 571 bp, Homo sapiens
  Payload ID: 5633
  Gene Symbol: EIF4E2
  Gene Name: eukaryotic translation initiation factor 4E family member 2
  ENST ID: ENST00000444113
  CDS Start-End: 1-366
agggtaggctgctctgctcctcggaaaggaaagtccagtgggacctcgctgctctgctcccagggcctgggaggagtttcatggcctggtgaacagcagcggccgctgatcggacgctccccctctgtctctcacactcaggggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatga

SEQ ID NO: 131343 - DNA, 1048 bp, Homo sapiens
  Payload ID: 5633
  Gene Symbol: EIF4E2
  Gene Name: eukaryotic translation initiation factor 4E family member 2
  ENST ID: ENST00000454501
  CDS Start-End: 408-1048
gctggggctggggcggcgcaaaccctgcggcaccggcttccctgctgggatccggctgcggccggacctggcctggactggcggggaggagggggctggggagcaatggataccggagtcccggagaccccagggccgtccgaaccgagggcgaagagctgggcccgggggaggggtggctgtgccgcccggtagggggagattttcggacgccccgccctggtggatgcggattgcctgcgacgtggaggggtggggacctcggcggtttgggtgtttccgcagtctggcagcgctgcctctgaatccagctttccccacacactccctctcccctctgagcctcagttttctcatctgcagagtggggacggtaacaccctttgtcgtagagtttggaggatgcaatgagtttgaaagatgatgacagtggggaccatgatcagaatgaagaaaacagcacacagaaagatggtgagaaggaaaaaacggaacgagacaagaatcagagcagtagcaagagaaaggctgttgtccctggaccggcagagcatcccctgcagtacaactacactttttggtactccaggagaacccccggccgtcccacgagctcacagagctatgaacagaatatcaaacagattggcacctttgcctctgtggagcagttctggaggttttatagccacatggtacgtcctggggacctgacaggccacagtgacttccatctcttcaaagaaggaattaaacccatgtgggaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggaagacattatttcaatatggaataagactgccagtgaccaagcaaccacagcccgaatccgggacacacttcggcgagtgcttaacctacctcccaacaccattatggaatacaaaactcacaccga

SEQ ID NO: 131344 - DNA, 2764 bp, Homo sapiens
  Payload ID: 5634
  Gene Symbol: EIF4E3
  Gene Name: eukaryotic translation initiation factor 4E family member 3
  Uniprot ID: Q8N5X7
  ENST ID: ENST00000295612
  CDS Start-End: 453-809
gcgcgcagcgcggccgccgccgccagccccgccgaggcatcccgcaccgcctgggcccggctgggctgggggcgcctccgcagcagccgcggggtcgggaggcggccgggagggaggcagggcccaggacgcaaggtggcgacaagtcgcgtttggccccaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcac

SEQ ID NO: 131345 - DNA, 6083 bp, Homo sapiens
  Payload ID: 5634
  Gene Symbol: EIF4E3
  Gene Name: eukaryotic translation initiation factor 4E family member 3
  Uniprot ID: Q8N5X7
  ENST ID: ENST00000389826
  CDS Start-End: 336-692
gctgatgggattaccagctcctgctaattgcatatgagtgctcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgttcacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatg

SEQ ID NO: 131346 - DNA, 9949 bp, Homo sapiens
  Payload ID: 5634
  Gene Symbol: EIF4E3
  Gene Name: eukaryotic translation initiation factor 4E family member 3
  Uniprot ID: Q8N5X7
  ENST ID: ENST00000425534
  CDS Start-End: 9-683
cggagaaaatggcgctgcccccggccgccgcgccccccgccggggcccgggagccgccggggtcccgcgccgccgccgctgccgccgcccccgagccgccgctcggcctgcagcagctgtcggcgctgcagcctgagccgggcggggtcccgctgcactcgtcctggaccttctggctcgacagatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgttcacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatgaagtaaattgagtgtttctgagttttctatagaaaatttatgctacctctcatcttttcacatacaaataagcaacttttaatgaaggcttagggtgaaaattttaattttagcactttacattacatgatgaatggtgaatattaaaggactttgaacattttaataaacttacagtgtttctgttttcaaatagaggtattgatgctgtggatatacattaaattctccccaaagttctcagactttaatcagataatgtggcttacaaccattgtttttgtttttaagttttaacactgtcttttcagtattcatttaaaacaagtcaccatgactttgaatatattctcatggagaatttatttcaatgattatataaaagaatttcaaaatttaaactagtgagcatactttagcttgagacagctaacattatttgtcccaaatttaaaatcttacattgaaagttattaattctttagaatagtcttacctgtgtaagttgaaccaggtttgtttgattatgttttggatctgcttgtgcccccacccccctattttataccatctgtgccctgtgcagttggggaccctttcacatctggctacaagctggtgtaatgcccttccttttgatctggcttcatctagtgatttgctcagtatttttaaggtcagactgaaaacttttctgttctagttatttttgattttatattgtgtgttgtgtttgatgttcagatacatgtgaaagttgcttctataagtcagtattttttattccagccttttgcagcaataaggtaagactagactatacttttcttacttgaaaaggtagtgatttatgtgtttagtgcaaatgtttagactgttttgcaattttctaatttgggactatattgctatgaatttgtgcttcttcatttttcagggtagtagttcacagggtttgtttaagtgttagtttgtagaactttattttgagatcttttgtaatctgttgctactaattctcattctgtattgaggttcttatagtatagaaatgtcattttcatcctccagtttaaaaatttcatgcagtttaatcaaccacatcacttaatcattattagatttccagtgtgtgtgtggtgattagaataaccttgtttattacaacacatattaaaagtttctgtccaacacctctaatatgtgtgacgctgctagcatggagtctgacgcttagtaggttatctggtattctgatggggagtaactgttgttatttttacacttccctgttgaacacatttgataatagggctcatctgggtctcttagaaaacgtatcttgcttattttaattctttttctttaccctctattaagaatggttccgttttagaataagtcaattactctcgttgctcttttgtgctgcaatttgctggtgagattcagttgtcccctgtttcggcaagtaaagtgaatttactcctcctttctggctgtctaatatattcctttaaaaacaaacaaaacgtaccaacaaactcttcttccattcatctgcagactttcctatctctccctgcagaaacaagcaattcaggatcttatgtgtgatgcctaattaattttaacacagcgaatttaatgaaatcgttgaagagcagggcataacactaggaaggctttaaaatttcataatgtttccctctcatatttgcatctgattactgccaccatgcattctgtgtgtactttatcatctagtcgttattgatgcactttttggaatgtgttctcggttgttctattagcataggttcctctgccttgtcacctaacgtacagttttcttggaagccaagaccatgcatgccttttcttcctcagtgatcctttcgctgcagtaactgctattaaagaacttttaactgcttttcgttaatgaatgcataaaaaaatctctggaatcctacaagacgatggttcttttgttacatgaagaaaagaaaaaacagtagcatttgcaagggccagcaagttaaaatatatgtcattaaaatatgtttctatttcccatcatctggctaggctgtggtgctgactagcttatttcttgccagagaaaataagtttaaatcataagcatatttaactagcaagcataaatcataaattctttataatcgtaagcatgttgaactctggtaccatttgtacagatggcagggctaaatgtgtgtgctcctctaagcattaaagatgtggacaagctcttactccccaatttcctctttaactcaggaaacttaaatcatttgttttttgcacatataggattatataaagtatggacctagagaaaggtttcagatcttaggaaacatttgagttttgtgattcatgcttactggaaaagaatgatggaagtgaaggttaaacactaaagccgtgtcccctttttaaggcgaaaataattagtgtttcatgaagatagtcaagttataaaggacaagactgtttttcagaatttttttttttttttgaaaacaaacatcttggaatccacattttaacagaggtccatcagctttcaaagagtgttccctagaagggtggttccacagaaacactttcagatatggcaaagttttcattgtaaaatacattttaagaagtatttttaaaagtgtaataaagcaataacacacagtgacatgcatcacatggccaaattttaacattttggaagccagtaagtataacttatgtactcactgattttgttttatgaaatgaaacaaaggttttataaaacctttttattgtaaaataaaggtacagaaaaccacacaaaacaaatgtgtaacttactgaattgttacaaggagaacactctataacagcaggccaagaaatagaactttgccggtcaccccaggagccctttcttgtgtccccgccctctccactaaaataaccattatcctgacctacaggagacacttgcatttctctctggttttatcacaggtgataaacatcattttacatatagaatcttctctaactatgaacgttggttcagaaaacttatttgtaagtcttttaaatgatgagtgcaaaatgacacactataagcaattgatacccccgtaagttagtaactgggcagaatttaatgtgcttttgctgtagtgtgtggctctgtccatagctataatatccacaataacaatagcatgtatggagttccatgccatctaagcatagaggttagttctccccaacactctacgaggtagatgctgtcattgttgtccccagtttgtgtatgtggaaacatatgcatgaggttcagagaggtgaaataacttgccgaaggtcacaccagtagtcagttgcagaaccaagatacatctaaggtactgtggctccagcctgttcttcagtgaggctgccttggtggaagttgaagatatgatgtgcaagaattttgagattccttatgagagtttgtttacaaagaaaaggttttacagctttaagaaaaagatggaaaaatcactggcctagttcaaacttttcattttacagatgaagaaatgacccagaaagtataaagaattcgttcaaggtcacacaagtagttggtggcaaagttgcagctatatcccaaatctcctggctgttaaaatcaatgatcttttcttcattccatatattatgtggaaaaaatgcatgttttctaacctgcttctttgcgacaactccatgtaagcagatttgtcttaaaaccagtttatagctaggacacaccatctacttgcttattttctcaaggttttaactgggaattaaaaaatttatatctg

SEQ ID NO: 131347 - DNA, 6209 bp, Homo sapiens
  Payload ID: 5634
  Gene Symbol: EIF4E3
  Gene Name: eukaryotic translation initiation factor 4E family member 3
  Uniprot ID: Q8N5X7
  ENST ID: ENST00000448225
  CDS Start-End: 460-816
ggaaggcggcgtggaagcagaagagcgcggccaggaaggcgagcagcttgcagcccagcgcgcccggcggcgcccccgccgcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccctttttcatgtaggtgcaggaagttaaatctcatttccaggatgcatgtgaacatttacaaagttgaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggatttttaattcctcttgcagtgttgaccagcagagagacttgaggctactttaagcctccactatgtgtttgtagataaaattctccattcaaacattttaaaggactttgaacattatctgcttatggaagttgtgcccttcacttggttagtaaccacctcagccataatacttaccatcataggtttcttaaaatgctttttttttttccctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatgaattaaaacttttttataatataagtatttttctgattgaaaaaaggatataattgacttcactctaattgtcatgtatatttccataagtaaatggattttgaagtatttttattttttgaactttatttaaagcatttgtgatgacatgttcaacttttgcatgtatgtagcctttgaagtaaaaataaataggaatgttaggctcacgttaatatttctagtttctgtttatgatcatggaacatgactagcacacaaagtagatttttgccccagtgaacttctgcaactgtttctgaccctttagaaaataccaactgtgagaaggatttaatttgcctaatgttaaaaacctatcatctaaattactttcagagaggattttgtcagattttggtttggaaattgttttaattgaatatttaatcataatagactttgtatgaactaagctgatttaatcagtttaaaaacctctcattaccttcttagattaaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcccaactcttagaggatcccagcttgtgtctttagacaaaactgacagcctttggaacgatcgcatggtggcgctgccttccagccaacagttctggctcagcagcagaatttatccagctatgtttgtagaatttttttaagatcctactgcattttgctcttaagcttttataaaaatttgacgagaaaatgtaaaaatgatacttggcaataagacatttagttttcatgcacctaataaaaatgtgtcaaagctagatcgctccagatgtgcttaaaatatctcaaatcctaggctctcattggccttataagtgattgggaagaaaaagaataaaataaactcacatataggagatatggaaaatatttcatcaaatattatgcccaaagagagaaaattaggagttgattttttttagcactctgaatatggaacttccttttaaaaatgtaattctacccttcacctttcctacattgtatgtttctgtgagattttactcattacaagtgaaagtagaggactgcctgtgaattgttcacttctgaaaagaatatattgagatcagttaaaattactcaagagtttggtgactcaggattgtaaaaagcctggatctcaacagctgggaggagtcagagggtgaagtgggaaaaaatagggactgagaggcaacgaaaagtccctttgaacctgtggtcatttatagcaattagagtgggttgcccctctacttctcccaagaagaaatcccaaatagattcctttcatgtcagattatactgttctgattttattttctattatttttacatatacatccaaatctaagaatacttattcagattggcccactcaggccaaaagtcactgtcttgtgttctagaaattctttcatgttgctgacataaatccatttttaaaagaacattcagggactcttagaattttagagtggaagggacctttgagatcatctaccagtgcttctcaccccttagcatgcagcaaaatcactcagatacttacttattattcacatttcttgaccccagcactagaaatctgggaggatatctgcatttttaacaagtgccctagtgattctaatgctgatggtgctcagatcgctcttggagaacccctgattttatccaactcccacatatgacaaatgaggaaagcctcccaaccctaagctctgtcaggtgacctgattccaatgtatgataccaacaatcttatgaaggctggagaaaaccattaatactgagacttgagtagatgatgctcgtgaataagaactttatggctgggaccacagcagtcatgggagcccatccctggaagtccataatataaagcctttaatacagagtggtggtttttctcttttctaaataccatttcagtctgttaagagaaaagaaattagtgttcagaaaagtagttactccatatgtgcagtaactacttttctataatgtcttatggcatctggggttcagcatcattgaacaagattaaatgaacgttatagagctataaaattgcatgtaaaataacacaaaactgttcaaatgactatcaaagtagcctgggaatgaatttccactaaaattaattgtcactttcaaaacgtagcttagcaaagctgttactaaactggagagatcctttaatacatagaaatgtcaaaaaaatcaaataagtattccctaaacgatgtgagtgataagcaaaagtcattgcaaagtcagtatttttttgttcatcattgctactgaaattcagagttccattgtatatgtgtgtcttgagtgtaccttattagaatatccaatacaatagcttttggatattctatgcttttgtgtccttcagaaatcatgagattgaaggaatctgtgttaaatgtttttgttttggttgctgcctgaaaaaagttaccaactcatttagtgaaatgcaagatttctttatgaaaatttcaatttctaatatcgaagtcagataatttttcttgaacttttattttggaacagatgtttatttcggatctattaaagtgtcaactttgcattatagaactgaacatgaa

SEQ ID NO: 131348 - DNA, 777 bp, Homo sapiens
  Payload ID: 5634
  Gene Symbol: EIF4E3
  Gene Name: eukaryotic translation initiation factor 4E family member 3
  Uniprot ID: Q8N5X7
  ENST ID: ENST00000421769
  CDS Start-End: 421-777
agttggcggccgcctggccggtggcgcccgggccgtggaaggtccagtcgtggctgacggcgggcaccaggcgcgcgggccgcatcttgcggcggtcgtggatgaagaagagcaggcggaggtagacgaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccccacataacttttaaagcagtattttataaaccccatgaagagcatcatgcttttgaaggtggacgtggaaaacactaa

SEQ ID NO: 131349 - DNA, 613 bp, Homo sapiens
  Payload ID: 5634
  Gene Symbol: EIF4E3
  Gene Name: eukaryotic translation initiation factor 4E family member 3
  ENST ID: ENST00000496214
  CDS Start-End: 460-613
ggaaggcggcgtggaagcagaagagcgcggccaggaaggcgagcagcttgcagcccagcgcgcccggcggcgcccccgccgcggccgccgcacgccgcgccgccagcatgacggccgggaggcaggcgagcgcgcgcagcccgtcggccaggcacaggtcgagcagcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcag

SEQ ID NO: 131350 - DNA, 693 bp, Homo sapiens
  Payload ID: 5634
  Gene Symbol: EIF4E3
  Gene Name: eukaryotic translation initiation factor 4E family member 3
  ENST ID: ENST00000497838
  CDS Start-End: 415-693
gtagaagagagaggaccacttgttgctaggcaaccagcacccacctcacccatgttgccatggtgatgatgaaagttgggctgatgggattaccagctcctgctaattgcatatgagtgctcaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacagttcacagactgtgccgcagcagatgatgaagtaataggagttagtgtcagtgttcgggaccgagaagacgtcgtccaagtctggaatgtaaatgcctctttagtgggtgaagcgactgttttagaaaagatctatgaacttctgccc

SEQ ID NO: 131351 - DNA, 519 bp, Homo sapiens
  Payload ID: 5634
  Gene Symbol: EIF4E3
  Gene Name: eukaryotic translation initiation factor 4E family member 3
  ENST ID: ENST00000469524
  CDS Start-End: 388-519
ggtgactggatgctggaggggaggggagtagctgctgcagctaattgcttaattatttatgagtgcctcaagtccttcttgttgtttttgttgctaggggctgtggggtcaccttctcttcctctcttctgccaccccaagtcgtctgtgttgcgtgtcatgcagtgggacagcacgttggtccggacctcaagctacccacgttctagtcccgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttaatgagaggagagaggcgaccactttgggaagaggagagtaatgcaaagggtggcgtatggaagatgaaagtccccaaggacagcacgtccacagtttggaaagagttgctgttagcaaccatcggggaacag

SEQ ID NO: 131352 - DNA, 3544 bp, Homo sapiens
  Payload ID: 5635
  Gene Symbol: EIF4ENIF1
  Gene Name: eukaryotic translation initiation factor 4E nuclear import factor 1
  Uniprot ID: Q9NRA8
  ENST ID: ENST00000330125
  CDS Start-End: 76-3033
ggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatg

SEQ ID NO: 131353 - DNA, 3115 bp, Homo sapiens
  Payload ID: 5635
  Gene Symbol: EIF4ENIF1
  Gene Name: eukaryotic translation initiation factor 4E nuclear import factor 1
  Uniprot ID: Q9NRA8
  ENST ID: ENST00000344710
  CDS Start-End: 159-2594
gagacagcccaagccggtcggggtgggggcgcgagagcgaaggctgcggggagcggcgctgggaccggtgcgggcagcggggaggggagcggcggccgaggcaaagggccgccgagcggcggaggcaccgagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaagcgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagcagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaagtaactga

SEQ ID NO: 131354 - DNA, 251 bp, Homo sapiens
  Payload ID: 5635
  Gene Symbol: EIF4ENIF1
  Gene Name: eukaryotic translation initiation factor 4E nuclear import factor 1
  ENST ID: ENST00000397518
  CDS Start-End: 61-251
gcgcgcggcggggaaggcggcgccggggccagggtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctga

SEQ ID NO: 131355 - DNA, 374 bp, Homo sapiens
  Payload ID: 5635
  Gene Symbol: EIF4ENIF1
  Gene Name: eukaryotic translation initiation factor 4E nuclear import factor 1
  ENST ID: ENST00000397520
  CDS Start-End: 184-374
gttcacagggagtggaaaccggaacccgtggagtatgacccgcccatgcgtggacccggcaggttgctacaacttgcacttggaggggagaggtcccaaggcccccgaattagaaatgccaggctcatctctttttgtaacccttcattttaaaatgtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctga

SEQ ID NO: 131356 - DNA, 3420 bp, Homo sapiens
  Payload ID: 5635
  Gene Symbol: EIF4ENIF1
  Gene Name: eukaryotic translation initiation factor 4E nuclear import factor 1
  ENST ID: ENST00000397523
  CDS Start-End: 28-2913
gtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtg

SEQ ID NO: 131357 - DNA, 3695 bp, Homo sapiens
  Payload ID: 5635
  Gene Symbol: EIF4ENIF1
  Gene Name: eukaryotic translation initiation factor 4E nuclear import factor 1
  Uniprot ID: Q9NRA8
  ENST ID: ENST00000397525
  CDS Start-End: 225-3182
gcgggcgccggggcgcccgcagggggtgggcaggggcgcgaggcccgcaaggcggccggcgggtagccggcgggctggctggcggggaccgagccgccgggccggggaggacggctgcgggcctgcgctagctccagcttgaagcgcccgggccgggagattcggcctccctcctccctgcggccggccgcccctcagtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcaggagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcgatgatagaagatgttttgggagaagggtcagtctctgccagtcggttcagtaggtggttctctaacccgagcagatcaggaagccgatccagcagtcttgggtcaacaccacatgaagagctagagagacttgcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaa

SEQ ID NO: 131358 - DNA, 861 bp, Homo sapiens
  Payload ID: 5635
  Gene Symbol: EIF4ENIF1
  Gene Name: eukaryotic translation initiation factor 4E nuclear import factor 1
  ENST ID: ENST00000445424
  CDS Start-End: 1-284
ctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacagattcaatgttcttatcaaactcccttgatgcaggtttgctacatcagcagttttttggccagagctgacaggcaacagcgagtgaccaagtcaccagcacccgtgcatcgagggaattcctcttcccctgcccctgctgcctccatcacaagcatgctttctccttcctttacccctacctcagtgattcgtaagatgtacgagagcaaagagaaaagcaaggaggagccagcatctggaaaagcagctcttggtgacagtaaagaggatactcagaaggccagtgaagaaaacctcctgtcatccagctctgtacccagtgccgatcgagactcttctcccactacaaattccaaactgtcagcattacagaggtcttcgtgttccaccccactgtcccaggccaaccgttacaccaaagaacaagattatcgacctaaagcaactgggagaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatcc

SEQ ID NO: 131359 - DNA, 688 bp, Homo sapiens
  Payload ID: 5635
  Gene Symbol: EIF4ENIF1
  Gene Name: eukaryotic translation initiation factor 4E nuclear import factor 1
  ENST ID: ENST00000423097
  CDS Start-End: 123-688
tggccacaggtgcggctggcctggcgaggggcgctcgggccccgtccccagtccctgatcgccggataacaaggggcagctggcgccgtccattggtgcagagcattgtagaccaaggagccatggataggagaagtatgggtgaaacagaaagtggagatgctttccttgacctgaagaagcctcctgcctccaaatgcccccatcgctatacaaaagaagaactcttggatataaaagaactcccccattccaaacagaggccttcatgcctttctgaaaaatatgacagtgatggtgtctgggaccctgagaagtggcatgcctctctctacccagcttcagggcggagctcaccagtggaaagtctgaagaaagagttggatacagaccggccttccctggtgcgcaggatagtagatccacgagagcgtgtgaaagaagatgacttagatgttgttctcagccctcagagacggagctttggagggggctgccacgtgacagccgctgttagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggactt

SEQ ID NO: 131360 - DNA, 718 bp, Homo sapiens
  Payload ID: 5635
  Gene Symbol: EIF4ENIF1
  Gene Name: eukaryotic translation initiation factor 4E nuclear import factor 1
  ENST ID: ENST00000418321
  CDS Start-End: 1-718
cagaaagccaaagtggatttgaaacctcttctttccagcctttctgcaaataaagaaaaacttaaagaaagctcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagccgaaaccttgaaagccatttgatgtcccctgctgagattccaggccagcctgtccctaagaacatcctgcaggtgtttcaaactcgagcagcctcagctgactaccttcgcccaagaataccatcaccaattggtttcacaccaggaccacagcagctactcggagatccattccaaggcatgcgcaaacccatgagccccatcacagcccagatgagccagctggagttgcaacaggcagctttagaagggctggccttgccacatgaccttgctgtacaggcagcaaacttctaccagcctggttttggcaaaccacaggtggacagaaccagagatggattcagaaacaggcaacagcgagtgaccaagtcaccagcacccgtgcatcgagggaattcctcttcccctg

SEQ ID NO: 131361 - DNA, 2679 bp, Homo sapiens
  Payload ID: 5636
  Gene Symbol: EIF4H
  Gene Name: eukaryotic translation initiation factor 4H
  Uniprot ID: Q15056
  ENST ID: ENST00000265753
  CDS Start-End: 140-886
gcgcgcgcgtgcgcgtgcctgcgtccaagggatttgcgatcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaa

SEQ ID NO: 131362 - DNA, 2503 bp, Homo sapiens
  Payload ID: 5636
  Gene Symbol: EIF4H
  Gene Name: eukaryotic translation initiation factor 4H
  Uniprot ID: Q15056
  ENST ID: ENST00000353999
  CDS Start-End: 29-715
ctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 131363 - DNA, 5945 bp, Homo sapiens
  Payload ID: 5637
  Gene Symbol: EIF5
  Gene Name: eukaryotic translation initiation factor 5
  Uniprot ID: P55010
  ENST ID: ENST00000216554
  CDS Start-End: 677-1972
tctgggaaaggcggggggaggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatggggaggtttgctttctaaacaagtgcattctgaaattgacttaaaaatttttagtgtgggtcctaaagtttagagatgggcaaggaggtctctaatccaccgcttcccgcttgagaagggaggggtatcaaaattgagccccaagctgtttgttccagtgtaccaagcactgactttatgcctttggcctggagatggcagaagtgaaagctggccatctgcaaaaagcagataagtgagtttgaaccttttgcattttgttagctcagtcagtcctcatcgtggtcctgaggcataggtactgttgtaccaaggtcacttatctaacaaaataacccttcatgtattttaaatttatttgacaagtctgcagacaatccttatctaaccagctattttcttaattgctacagcttgacctaccagtattccggagtaaccagcaaatgcaaagttgaccttgttcctgcatcatctttttgatggttcaaatttcagcctccctgactactacaaagccagagcagtcttagtaccagaaacagtgttgcactttcgttgcatgtgctgtgtgaccccaaggggacagggagtcactttggtcatctctgtccccagtacagatcttgattcatagtgacattccataagtggggtgacagcaaatgacttgcaggtagtctcattgtaggtttgtgcaccagagtgaccctgtgagcctttgttaataggttgggagctcagggtgtttatgtccacctgtctggtctagccaaacagtttttttctgggaatcaaatttctgtggtttttatggccagaaattttaaggacttgtgtgtgctgggatatgagaatagaagctacagagttcttttcttgggacctagactgggaggtgcaatgtcaggacctccaggtgaatggtaggatctgagttgaccctgcagttcggttatgcagtcaattatttctttttaagaggaggaggattcacttgggtgttgggatcaaatttggattctgtcccaggccttactgtaaaactaggggattgcctttccatatctgctgggggtggagacccttatgtgcagcactcaatcccactggaagcctaatgctgcagtcagaagcaatgcctggctggggcagtaggggaaattccacccaattttgctatgagcctaaaacctctttaaaaacggtcagttaactaaaaaataaaaatcaagtctttaggagagtagaaaacacaattaactaaaaagcagggacatctgaaagagacgtattaagttaacatttttaaaaatccaaatgaaagtaaatggaataaatgtatcaggtaaaggacaagttgtaagcttggatttttaggtctagcaatacactgtttacaagagcatcacctaaaatgtgacaaaagatgttgaaaggatgaaaaaaggtatagtagacatacactaaccaaaaatgtagctctttgaatctcagaaaaaagtagattttaataaagtgtgaaagttgtcaatcaaa

SEQ ID NO: 131364 - DNA, 3417 bp, Homo sapiens
  Payload ID: 5637
  Gene Symbol: EIF5
  Gene Name: eukaryotic translation initiation factor 5
  Uniprot ID: P55010
  ENST ID: ENST00000392715
  CDS Start-End: 534-1829
gggggcggcccgatcccggcacccctcggccgtgtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaaagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttga

SEQ ID NO: 131365 - DNA, 583 bp, Homo sapiens
  Payload ID: 5637
  Gene Symbol: EIF5
  Gene Name: eukaryotic translation initiation factor 5
  ENST ID: ENST00000559130
  CDS Start-End: 378-583
gtgtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcggtagccatggggaccagggcgaagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgt

SEQ ID NO: 131366 - DNA, 723 bp, Homo sapiens
  Payload ID: 5637
  Gene Symbol: EIF5
  Gene Name: eukaryotic translation initiation factor 5
  ENST ID: ENST00000560763
  CDS Start-End: 570-723
agtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgt

SEQ ID NO: 131367 - DNA, 569 bp, Homo sapiens
  Payload ID: 5637
  Gene Symbol: EIF5
  Gene Name: eukaryotic translation initiation factor 5
  ENST ID: ENST00000561325
  CDS Start-End: 243-569
gctcgggctgactcaggcttcagctgctgcatttagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttg

SEQ ID NO: 131368 - DNA, 719 bp, Homo sapiens
  Payload ID: 5637
  Gene Symbol: EIF5
  Gene Name: eukaryotic translation initiation factor 5
  ENST ID: ENST00000558316
  CDS Start-End: 281-719
aggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctg

SEQ ID NO: 131369 - DNA, 678 bp, Homo sapiens
  Payload ID: 5637
  Gene Symbol: EIF5
  Gene Name: eukaryotic translation initiation factor 5
  ENST ID: ENST00000559532
  CDS Start-End: 352-678
gtcgcttcccggctgtgcaccctccggggccgccggctctcgggggacgcgctggggatggggccagacgccccggtcgcgcgcccccctccttcgcggagctgcccggttcgccagcccccgcggaaacgcctcggagcgcgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttg

SEQ ID NO: 131370 - DNA, 580 bp, Homo sapiens
  Payload ID: 5637
  Gene Symbol: EIF5
  Gene Name: eukaryotic translation initiation factor 5
  ENST ID: ENST00000560338
  CDS Start-End: 278-580
gacgctggggccgagggtagcttgagcgcggcggcggcgttgttcagtcagagcgagaacattccagagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaa

SEQ ID NO: 131371 - DNA, 4384 bp, Homo sapiens
  Payload ID: 5637
  Gene Symbol: EIF5
  Gene Name: eukaryotic translation initiation factor 5
  Uniprot ID: P55010
  ENST ID: ENST00000558506
  CDS Start-End: 913-2208
ggggatggggccagacgccccggtcgcgcgcccccctccttcgcggagctgcccggttcgccagcccccgcggaaacgcctcggagcgcggtagccatggggaccagggcgaaggttaaccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgattttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaa

SEQ ID NO: 131372 - DNA, 872 bp, Homo sapiens
  Payload ID: 5637
  Gene Symbol: EIF5
  Gene Name: eukaryotic translation initiation factor 5
  ENST ID: ENST00000558265
  CDS Start-End: 272-872
gcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttgcatgtcaatccaaagaagcaaacaataggtaattcttgtaaagcctgtggctatcgaggcatgcttgacacacatcataaactctgcacattcattctcaaaaacccacctgagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggaagaagaggaggatg

SEQ ID NO: 131373 - DNA, 1256 bp, Homo sapiens
  Payload ID: 5638
  Gene Symbol: EIF5A
  Gene Name: eukaryotic translation initiation factor 5A
  Uniprot ID: P63241
  ENST ID: ENST00000336452
  CDS Start-End: 49-603
accacactagcgcgctagaagagtggggcggaaagacatctcccgcgcatgtgtggaactggggggactgattccaagacaaggcgcccaccccacagagcaagttttctgaaacgtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaa

SEQ ID NO: 131374 - DNA, 1511 bp, Homo sapiens
  Payload ID: 5638
  Gene Symbol: EIF5A
  Gene Name: eukaryotic translation initiation factor 5A
  Uniprot ID: P63241
  ENST ID: ENST00000336458
  CDS Start-End: 402-866
gggagggaagatgaggttgaagagattaaaaaaccgggtgcgcctgcgcgttgcagattagttgaaaacgctcagggtttgtgaggggcggggtcacgtatgcgcgtcattggacgggtcggtgggagggagggtggagatgggtagggtgtgtgcgcttgcgcagtgcgggggtggagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 131375 - DNA, 1271 bp, Homo sapiens
  Payload ID: 5638
  Gene Symbol: EIF5A
  Gene Name: eukaryotic translation initiation factor 5A
  Uniprot ID: P63241
  ENST ID: ENST00000419711
  CDS Start-End: 162-626
gggggacggcgagccgcgaggcagccacgcgggagaggccgccaggcggccacgccggggcgagggccaggggccagatcggcccaccggggcaagggtacctgggccgttgaggacccggctcagcgcggccacgtgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 131376 - DNA, 1336 bp, Homo sapiens
  Payload ID: 5638
  Gene Symbol: EIF5A
  Gene Name: eukaryotic translation initiation factor 5A
  Uniprot ID: P63241
  ENST ID: ENST00000416016
  CDS Start-End: 227-691
gcaggagccggcagcccctagcgcggggagctagtcctcgcgggggttccgagggggcctgagattttgaggagtggaagccggaggctcgggtcctaatcaccccggagggcctgctgcaggcatatgttagcgcttcccaacctcaagggccccaggagctttcctgaaaaaccctcctgtgaagtgtggcggtcagccaggtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 131377 - DNA, 1366 bp, Homo sapiens
  Payload ID: 5638
  Gene Symbol: EIF5A
  Gene Name: eukaryotic translation initiation factor 5A
  Uniprot ID: P63241
  ENST ID: ENST00000571955
  CDS Start-End: 257-721
gggggacggcgagccgcgaggcagccacgcgggagaggccgccaggcggccacgccggggcgagggccaggggccagatcggcccaccggggcaagggtacctgggccgttgaggacccggctcagcgcggccacgtgagggcctgctgcaggcatatgttagcgcttcccaacctcaagggccccaggagctttcctgaaaaaccctcctgtgaagtgtggcggtcagccaggtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 131378 - DNA, 1439 bp, Homo sapiens
  Payload ID: 5638
  Gene Symbol: EIF5A
  Gene Name: eukaryotic translation initiation factor 5A
  Uniprot ID: P63241
  ENST ID: ENST00000576930
  CDS Start-End: 330-794
gcgggggtggagggcggaggagatagatagcacgcttgcgcggctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagggcctgctgcaggcatatgttagcgcttcccaacctcaagggccccaggagctttcctgaaaaaccctcctgtgaagtgtggcggtcagccaggtttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaa

SEQ ID NO: 131379 - DNA, 1089 bp, Homo sapiens
  Payload ID: 5638
  Gene Symbol: EIF5A
  Gene Name: eukaryotic translation initiation factor 5A
  Uniprot ID: P63241
  ENST ID: ENST00000573542
  CDS Start-End: 191-655
ttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccacccc

SEQ ID NO: 131380 - DNA, 602 bp, Homo sapiens
  Payload ID: 5638
  Gene Symbol: EIF5A
  Gene Name: eukaryotic translation initiation factor 5A
  ENST ID: ENST00000573714
  CDS Start-End: 163-602
ggcagccacgcgggagaggccgccaggcggccacgccggggcgagggccaggggccagatcggcccaccggggcaagggtacctgggccgttgaggacccggctcagcgcggccacgtgaggtgggggagggggctattcgttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgt

SEQ ID NO: 131381 - DNA, 811 bp, Homo sapiens
  Payload ID: 5638
  Gene Symbol: EIF5A
  Gene Name: eukaryotic translation initiation factor 5A
  ENST ID: ENST00000572815
  CDS Start-End: 193-753
gctgtcatagggctgcttggttggtcagtggggagtcggcgcctgcgtactaagacccgtgtgcagcagcggcggcggcggtagaggcggcggcggcggcggcagcgggctcggaggcagcggttgggctcgcggcgagcggacggggtcgagtcagtgcgttcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctggtatggtgcctccctccctgcttctgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccagggtggcggtggtggcagcagtgatcctctgaacctgcagaggccccc

SEQ ID NO: 131382 - DNA, 5593 bp, Homo sapiens
  Payload ID: 5639
  Gene Symbol: EIF5A2
  Gene Name: eukaryotic translation initiation factor 5A2
  Uniprot ID: Q9GZV4
  ENST ID: ENST00000295822
  CDS Start-End: 187-648
gggtaagggcggggaggctggggtgtggaaagtgtggcggccccgccccgtctcttggaactgccgcggccgccaccgccgctgccggcgccgctgctgtaggggaccagcgcgggtgcgcagacgaaaggcgctctttgccagctgaaagttcccacggaaaaactaccatctcccctgcccaccatggcagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggttcaccttgttggaattgatattttcacgggcaaaaaatatgaagatatttgtccttctactcacaacatggatgttccaaatattaagagaaatgattatcaactgatatgcattcaagatggttacctttccctgctgacagaaactggtgaagttcgtgaggatcttaaactgccagaaggtgaactaggcaaagaaatagagggaaaatacaatgcaggtgaagatgtacaggtgtctgtcatgtgtgcaatgagtgaagaatatgctgtagccataaaaccctgcaaataaacggaaacatcaggcatgaacactgtttatgtctgaatcaactgcagatctaatttggttctaagttgtcaccaaagctatagccttcataagcaacctcatttctttttttaattgttttcagattgtgctgggttagttttgcaagcaattgataatttttaaaaaattatcaatatgtataattttttttgaattttgtagatatgtttcctataatattcctgtggttttcagtatgtcagtccaagaaacaaacaagatagcttcagcagatgtgatttgtctgagcaaatcattcctgtgttttagttagatgataaaccagggttttaaatcaaacaatgtagcataaagtggtattgaagtaccatatttaagttgaactgctctgcattaattacagatttaatataaaatgaactgattatatattggaattgttgcactttcagcctgtgtagggcaaacacaaatccttaaacaaaaatcatgttatcaaaaactgtcagttattttggtggccacatgcaaccatgtgattactttggtcatactatttaccaaattgttggcaaacttgatgtaaccttatatggtggttttagtcccttcttatggttggcagaagggcactgaactgttgggtgaaagttagttagcaagtaagattataaggaagacacaaaagacagtggcaaagagggttgattaaatctataagtttttatgtgaggactttgtaagtcagcataaaaatgaaaagttgtttctcagttgtttttgcttttaactttgcccccaacgtttaaagggagtgatctgctttacatgatactatgcaatgcttgttttccaactatgttgaataaatagtaatatttatcagtaaatactcctttccaacttccttttttttttttttttttttgagactgagtctcactccatcagccaggctggagtgcagtggtgcaatctcggctcactgcaacctctgcctcccgagttcaagcaattctcctgcctcagcctcccaagtagctgggactacaggtgcatgccaccacgcccagctacttttttgtgtattttagtagagatggggtttcaccatgttgtctaggctggtcttgaactcctgacctcaggtgatccacctgcctcagcctcccaaagtgctgggattacaggcatgagccaccacacccagcccctttccaaccatttctaagtagattttttgacattaatgtatttattaaacaaaaactgagaattccttaaattgatttggaatttttgttaattttatgtcctttttttcctaaagtgaattaaagtgaatcatggaagcagcattactttatatgaatattattatttaagttaagttattttaagtatatgcattttttctgattgttgtgtgacttaattcagttgctggtgtgaactataactagcaaataattctataaactgaattattttaaaaggtattttaggtgacaccactgcatttctatttcatcttttgagtcatatgtatattatttccagaattttagacattattacagggtttgtgaggacctttgactcagtgacaatcatcatattggagcaaaacatagaacaaaatcactatctcagaaataccttaattctctaagactggctcttagacctctcccatcatgccttgacctctaaaaagccctttgttcctatcttctaaaggaaagtatatcatatatgatgatgtaactgatctaatcagtgactggaaatagcattagtaacagaagatcccaagttttagttgcttaatttgtacacacttttaaatattgtcttagcctcggcaaaccaatttggggaagaagcaagatactttaagagaaatacaaaggaaatttctaaagcacaagaaatagtgaggtagtagttagtcgtctttcctacaacattttagcttttgcccatctaaagcacaattaaaattaggctacattctttccagtattctatttaagtacctactacatactgctctagtttcttagtactctgtaatgtgtatcttaattgctactggttggcattgtaactcataggaattccagaaaattattaatccgtgctgcttgcagttcattcatatggcccctcttaaccatgctggtgttatgattcagtattaactctcaattagcatgcccctgttcttcctaacttgtaaaatttcacataaatatattttcaattgtgtacaaattaagggtgtacaaattataataatgcatctctatcttcatactttgaatggcaaacgctatttatgcataaatattttcattttaagtaatatatgaagtgtaaatactcgatatataagtatagattttaaagatatgggactttattttcacataagtcaatagatgtttctctagaacaaaatatttagtaaagctttataaattatattaaaaggaagcggggaacatgtattttttaacatagaacagaagtgacttcattctttttagacatcagaaatgttaaagttgattcccaatatttgttgtacttttttgtagcaaatgttaaaaatcacgagttaccatgtatagaatgtggactgtcatgttgatatcattgtacagtgataagccatttttatctgtatacatttcaccaatttattaacaggttgaatatttgtttctttttagaacattttatttatactgtgaagactttgttataccttatttgctacaacatagatcatatcattgctactttgacttagcatttgcatcataaacataattatgatgtttttttcatgctcccttccaggggctcagtcacttgaagaaactgttgctaaccaagctcttgactctgtttcccttaatgatacaagtctctgtaccagcgctttatgttaattaccaaaactctcctgcatcagagcatgatatctataataggagatactgcaataaaatgattaggctgtaaaatttggagacacaatttttcattacaatgcaatttgcatgtgcacatgtgcgcacataactttatatgttagttcttttttccaaactcccaactcttaaaagtattgtagtctgttggtgcctcaactgttggtaactttttttttttaaatttacaactttccacaacttgtttttgtactttaaggtttctcaattagaatatttctagttgagctgtaatttgaatgcattgttctcagggctatttgtgctaaaagctgaaatttcattattttaaagctaattgcctgaaaatatattggcagaattttcccaaattgtaataactgtgatacatgcatataaaaaaatccttaatgtcaacacacttaaactacatgctaaatagtcaagaaaaaaatggaaacagtagcatccatactggaatcttgccatatttttttcattttagaatagattttggcagtctcatcttagaatcctatccttaggatacatctgaaagcattcctttggcatggaccccagagatagttttggagccaggcattgatgtagaggttcaccaaacatatttagggataatagataaattcataatgcttttttgggtacactgaaatgtttacatactgaattctgtaatatgaactaggaacgcatttactatgagaaaatatggctcttaagcagtgtaagagtgaaaatataagcatatttccattaacagtatattgtactgatcagcagctctcattttaacatcagttaggcataatatttcatagttttcaagccttttttttctgctaacattcagacaagtaacaggcaacaaagatttaagaaaaatttatggtggaaaaccttaaaaattgagacaattcaatctatttaatctattaaattttttctctgaattgggtatatggcatcattatttgattttagcagggaacatttggatttagcttatgaaacacagatgttctatgggaacatggcttgaagccaatatgtaatttaatgtttttccattaaacaaacatctgaacaccaacttagctaccaagtgaggtcaagtgcctgaaaagtactgtatacatctaataagcatgttttccttatgtaaaagatgcactttatggcaatgcataccaggctttcacctgctagaaacatacttgttgccaactttgccatctaccactattctcctccttagaacaggtagaaacctattttacaaaaaaaaaaaaaaaaaaaaaaagacaggttattgtatttatatgaagtccctaaaactgtttcttggtattgatagacttaagtttatcttagttcaagattgcactttttaaaaaactctggactattttcagcaatgaccgaacagcttgtcacacatcatagttgtgatcttttttgaggagttatttattgtggttaatatctactataaataagcattcttgtgcttgttacaaagcataatgcaaattactagttctatactagtataatgaaaatgactagttctatactgttatgtacttttgtcttcctccccaaaaaggaaacagtttagcattgtctaaattcagtggcacttttttagtaatacatttttttttcttagatacaggagaactattgcttttacctgcagaaactcaaatgttttcgctaaaactttaaaattctaaaatacgtagtatgggtattactaattgtacattttacatttcaaaaatagttaaaattcaaatgttaagtctttgacttaaaaaacctttaaatatagataataccttaacaattataactttgtgatattattaaaatatatttgtctgttaacttcatcagttgtattaaataaaaatagttaacagcttgcacta

SEQ ID NO: 131383 - DNA, 457 bp, Homo sapiens
  Payload ID: 5639
  Gene Symbol: EIF5A2
  Gene Name: eukaryotic translation initiation factor 5A2
  ENST ID: ENST00000474417
  CDS Start-End: 113-457
gccgctgctgtaggggaccagcgcgggtgcgcagacgaaaggcgctctttgccagctgaaagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggttcaccttgttggaattgatattttcacgggcaaaaaatatgaagatatttgtccttctactcacaacatggatgttccaaatattaagagaaatgattatcaactgatatgcattcaagatggttacctttccctgctgacagaaactggtgaagttcgtgaggatcttaaactgccagaaggtgaactaggcaaagaaatagagggaaaatacaatgcaggtgaagatgtacag

SEQ ID NO: 131384 - DNA, 565 bp, Homo sapiens
  Payload ID: 5639
  Gene Symbol: EIF5A2
  Gene Name: eukaryotic translation initiation factor 5A2
  ENST ID: ENST00000487522
  CDS Start-End: 92-421
gctgtaggggaccagcgcgggtgcgcagacgaaaggcgctctttgccagctgaaagttcccacggaaaaactaccatctcccctgcccaccatggcagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggttcaccttgttggaattgatattttcacgggcaaaaaatatgaagatatttgtccttctactcacaacatggatgttccaaatattaagagaaatgattatcaagtgtctgtcatgtgtgcaatgagtgaagaatatgctgtagccataaaaccctgcaaataaacggaaacatcaggcatgaacactgtttatgtctgaatcaactgcagatctaatttggttctaagttgtcaccaaagctatagccttcataagcaacctcatttctttttttaattgttttcagattgtgctgggttagttttg

SEQ ID NO: 131385 - DNA, 570 bp, Homo sapiens
  Payload ID: 5639
  Gene Symbol: EIF5A2
  Gene Name: eukaryotic translation initiation factor 5A2
  ENST ID: ENST00000474096
  CDS Start-End: 138-455
gtctcttggaactgccgcggccgccaccgccgctgccggcgccgctgctgtaggggaccagcgcgggtgcgcagacgaaaggcgctctttgccagctgaaagttcccacggaaaaactaccatctcccctgcccaccatggcagacgaaattgatttcactactggagatgccggggcttccagcacttaccctatgcagtgctcggccttgcgcaaaaacggcttcgtggtgctcaaaggacgaccatgcaaaatagtggagatgtcaacttccaaaactggaaagcatggtcatgccaaggttcaccttgttggaattgatattttcacgggcaaaaaatatgaagatatttgtccttctactcacaacatggatgttccaaatattaagagaaatgattatcaaaaactggtgaagttcgtgaggatcttaaactgccagaaggtgaactaggcaaagaaatagagggaaaatacaatgcaggtgaagatgtacaggtgtctgtcatgtgtgcaatgagtgaagaatatgctgtagccataaaaccctgcaaataaacggaaacatc

SEQ ID NO: 131386 - DNA, 3840 bp, Homo sapiens
  Payload ID: 5640
  Gene Symbol: EIF5AL1
  Gene Name: eukaryotic translation initiation factor 5A-like 1
  Uniprot ID: Q6IS14
  ENST ID: ENST00000520547
  CDS Start-End: 50-514
ggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggttggactcctcctacacaatttatttgacgttttattttggttttccccaccccctcaatctgtcagggagcccctgcccttcacctagctcccttggccaggagcgagcgaagccatggccttggtgaagctgccctcctcttctcccctcacactacagccctggtgggggagaagggggtgggtgctgcttgtggtttagtcttttttttttttttaaattcaatctggaatcagaaagcggtggattctggcaaatggtccttgtgccctccccactcatccttggtctggtcccctgttgcccatagccctttaccctgagcaccacccaacagactggggaccagccccctcgcctgcctgtgtctctccccaaacccctttagatggggagggaagaagaggagaggggaggggacctgccccctcctcaggcatctgggaagggcctgcccccatgggctttacccttccctgcgggctctctccccgacacatttgttaaaatcaaacctgaataaaactacaagtttaatatgaaaaaaaaaaaaaaagaaagaaagacgtgtaaaatgccaagaactctaggaaacagggacaaaaacacttcaaagagaaagttcatgcacttgtttctgaccacccagggcacccttcagcacacgctgtctggagtggcctgaagcaaggagtgtcttgtgaggtgcagaggatgcaatgggagcagggtcctgtccccaccctaaaggagttcacagtttaacgcaaatgagaagccagtgaggacatcactactcctgctgtgaacttgggaactagaaacacaaaacctgagtctggagggaagctaaggaagcattctgctctggagtagacatgagtgcgtgtgaagcttctgatctcccatgagagcaatggggacatggggcagaatctaaaacccatgactgaaagcaccaaattgctaaaatggcaataaagagacatgaggccaagatggagaagaaggaacccaggacgagggtcagcctcacatttggggctcatttccctcagtttcctcactgaatttcagaagggactaactgagatgcaaagaagcagagcagcttttgcaccatgtggaggactagatggaaaacaagtagactgagggtctgctagtgaaggtgacccctactgaagtccactggctttggttgggacccagaagagtcacacgccaggaatagaggtggacaggaaacaccctgacttttgtagggactgaacctcactgataacctcaattgcggatggtatggagggtgtctaggtgtgctaggacccctgcccattccccagaaatagactcccatcttttctacagcaagataacgtgctagtaggcctcaattcattgctaaatatttttaacgagtgtcttacatttagccaaaaagactagtcatgtggcaggaaaaatacaatgtcatatgaccaaaagctaaaagactgtgaaaatgaatccagaggtgacccaagcattgaatttaacaatgccagtacctggacctccgcttgcccctaaaacattacaatcaagaatgtaggaagggaaaggaaacacgaagattaatcaagcaggaaggacaagctcagttttgcacccactgaatttgccacaaatattgtggaaaatattctcggggacattgcagttgtctactttggttggcacatggttcatacaacagtgtttgtgtcagtgaacatcttactcttcctcggcagtctttctttgcccagagatttcgcaatgactgttgaccttcatcatcaccttttggactttggcttgcactttagcttctgtagatctccatgatgtaaagaagtattttaggtccattttaattcctgcaaaggataaaatccttctatttgtgtgcatataagtggacctgagcccttggttagggtgtagagaggagaaggggagaaacctgagggccagaagctgttctttcccttaaaagggcaaactcatttccacactatggggactctgacagatagcataccttcctgtctatggctattggacctgcaggctttcccctgtaaatccgtgttctgtcattgacattttgtgactgtaagacagacttgagataagacatctagaaaacaataattgaacaatgatgtgaatatatttcacacaactgaactgtacatttcaacaaggttaagatggtaattatcacgttatacattttttaccgcaggttaaaatgtttcacaggttgaaaggaaagcaactaccttcagttctctgagttcaagaatttgtaacatttcaccccctgctccttcctgatcttctgtggagcatcttttttccatccatgctctactcagagcccactttcccttccctgacaccagcttcactgaggctggttggaacctaacacaaaacattctcagtaatgactgaattcccacaaagaattccatatagactgcatatgagttgaatcttctaagacatgaaatatttgttctcttcttggctaatatgcaatgcaaatcctgttgcagatgtacgtcatatacctctgaaattcctgatgtattcaatgaaataacatctttaaagttctgtgtagaatgttttttttctgatttcttcacatacgatagaaaaaaaaacccaaaaaaacatgtactaggatttcaatagaagcaatgggtgatctaaaaagatgaaagagcaaccgcatgcgccctacagctaccgctagattttatggggaaagcagctggcccagtttgcagctaggagaaatgtcaaacacatgaagaaatgagaagcaaagaaaaaccatgaggcatgaacatttcatggcaatcacgatgtcctggtttgtgagataatgggatagaggagtagaaaacaaggagaaagatgagaaggtacaaagtggttcaagtcaaacagctcaactgaacttttcttaatggaatatttaaaaagtggtacattaaaaaacttcccccagttcacatcaaaaattctctcttcaggactaagttgggtagagactgttcaatgtgcctagatatcttcagaacttatatattttctgttttctacgtatgttgaagggcagtgccaaatgatgtgtaattatctaggttgtaaaaataaaacatactcccccttcccttgaggataaaaaa

SEQ ID NO: 131387 - DNA, 5777 bp, Homo sapiens
  Payload ID: 5641
  Gene Symbol: EIF5B
  Gene Name: eukaryotic translation initiation factor 5B
  Uniprot ID: O60841
  ENST ID: ENST00000289371
  CDS Start-End: 203-3865
aggcggctgggcgatgcgcttgcgcactgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagatggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaatcttgatctgttttaatcttgatctgttttgtcctagaaaattccatcatacacacatttcctgatatttgggcttagtgcttctaaattgttgcagacacaaaacttaatgattcattcgtagtagtaatctgtagctagttttagggttttgctgaagtcagtgtggggtgtttgtttgaggaaaaagttccaaatatccactagcatagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacctctcaggaatttcagagcttagcagtctggcctggaggtttttcagccttttagtataataaacagtagttgcttcctagagttgagtttttaaggattcacaaaaaggagcctgtacaaaatatacatacagttctttattaaacaactgtaaacacttcactgtaaaaatccataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattccaaa

SEQ ID NO: 131388 - DNA, 4698 bp, Homo sapiens
  Payload ID: 5641
  Gene Symbol: EIF5B
  Gene Name: eukaryotic translation initiation factor 5B
  ENST ID: ENST00000617677
  CDS Start-End: 185-3847
cttgcgcactgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccaggcggtaaagaagatactgaggatgctggattggatgattgggaagctatggccagtgatgaggagacagaaaaagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagatggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaa

SEQ ID NO: 131389 - DNA, 1252 bp, Homo sapiens
  Payload ID: 5642
  Gene Symbol: EIF6
  Gene Name: eukaryotic translation initiation factor 6
  Uniprot ID: P56537
  ENST ID: ENST00000374436
  CDS Start-End: 229-966
gtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 131390 - DNA, 1017 bp, Homo sapiens
  Payload ID: 5642
  Gene Symbol: EIF6
  Gene Name: eukaryotic translation initiation factor 6
  Uniprot ID: P56537
  ENST ID: ENST00000374443
  CDS Start-End: 51-731
tccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 131391 - DNA, 1289 bp, Homo sapiens
  Payload ID: 5642
  Gene Symbol: EIF6
  Gene Name: eukaryotic translation initiation factor 6
  Uniprot ID: P56537
  ENST ID: ENST00000374450
  CDS Start-End: 266-1003
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 131392 - DNA, 551 bp, Homo sapiens
  Payload ID: 5642
  Gene Symbol: EIF6
  Gene Name: eukaryotic translation initiation factor 6
  ENST ID: ENST00000456600
  CDS Start-End: 227-551
gtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcacca

SEQ ID NO: 131393 - DNA, 798 bp, Homo sapiens
  Payload ID: 5642
  Gene Symbol: EIF6
  Gene Name: eukaryotic translation initiation factor 6
  ENST ID: ENST00000440766
  CDS Start-End: 37-216
ggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 131394 - DNA, 932 bp, Homo sapiens
  Payload ID: 5642
  Gene Symbol: EIF6
  Gene Name: eukaryotic translation initiation factor 6
  ENST ID: ENST00000447927
  CDS Start-End: 85-411
ggacggaagtggaaacggaaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtgggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaa

SEQ ID NO: 131395 - DNA, 739 bp, Homo sapiens
  Payload ID: 5642
  Gene Symbol: EIF6
  Gene Name: eukaryotic translation initiation factor 6
  ENST ID: ENST00000415116
  CDS Start-End: 67-627
aaacctttttagggagtccaaggtacagtcgccgcgtgcggagcttgttactggttacttggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggac

SEQ ID NO: 131396 - DNA, 1054 bp, Homo sapiens
  Payload ID: 5642
  Gene Symbol: EIF6
  Gene Name: eukaryotic translation initiation factor 6
  Uniprot ID: P56537
  ENST ID: ENST00000621148
  CDS Start-End: 27-764
gtgtgaggggaacctgggagggcctcatggcggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgcacgcgtctatcgccggctgccgcatcatcgggcgcatgtgtgtggggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaatgtg

SEQ ID NO: 131397 - DNA, 3742 bp, Homo sapiens
  Payload ID: 5643
  Gene Symbol: ETF1
  Gene Name: eukaryotic translation termination factor 1
  Uniprot ID: P62495
  ENST ID: ENST00000360541
  CDS Start-End: 223-1536
actcgcaccggccccctcccttccgcctgccgccttccactccgcccctggcggaggaagtgatgtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaag

SEQ ID NO: 131398 - DNA, 3874 bp, Homo sapiens
  Payload ID: 5643
  Gene Symbol: ETF1
  Gene Name: eukaryotic translation termination factor 1
  Uniprot ID: P62495
  ENST ID: ENST00000499810
  CDS Start-End: 450-1664
gccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatggggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaata

SEQ ID NO: 131399 - DNA, 1736 bp, Homo sapiens
  Payload ID: 5643
  Gene Symbol: ETF1
  Gene Name: eukaryotic translation termination factor 1
  ENST ID: ENST00000503014
  CDS Start-End: 150-1421
atagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacagcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaa

SEQ ID NO: 131400 - DNA, 745 bp, Homo sapiens
  Payload ID: 5643
  Gene Symbol: ETF1
  Gene Name: eukaryotic translation termination factor 1
  ENST ID: ENST00000512198
  CDS Start-End: 74-361
cgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatc

SEQ ID NO: 131401 - DNA, 713 bp, Homo sapiens
  Payload ID: 5643
  Gene Symbol: ETF1
  Gene Name: eukaryotic translation termination factor 1
  ENST ID: ENST00000507939
  CDS Start-End: 355-713
aacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggacgttaaccctctgggcgaagcattgatgaaagctttgataagccaaagtgcccctaaaaccaatgagaacaagaagagaatctgagtgcagaggcccctgggagctttgagggatacattgctcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatgg

SEQ ID NO: 131402 - DNA, 990 bp, Homo sapiens
  Payload ID: 5643
  Gene Symbol: ETF1
  Gene Name: eukaryotic translation termination factor 1
  ENST ID: ENST00000572514
  CDS Start-End: 366-990
ggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgt

SEQ ID NO: 131403 - DNA, 1815 bp, Homo sapiens
  Payload ID: 5644
  Gene Symbol: EVA1A
  Gene Name: eva-1 homolog A (C. elegans)
  Uniprot ID: Q9H8M9
  ENST ID: ENST00000233712
  CDS Start-End: 439-897
agcataacctgtttgtgaaactgcaaaaaggttgacatggctgaagcagaagatgggttggtactgaatggttgggagagatatgtagcggctgaccctgaaggacgttgcagcccatgctatggagacctgattttattttgtaagaggtgggcaacccctgaagcattttagtgatgcgaacagatgtgtctgttaccaagcaaagccagttaaagaaggtcacagaggaggaatgatcacaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 131404 - DNA, 1802 bp, Homo sapiens
  Payload ID: 5644
  Gene Symbol: EVA1A
  Gene Name: eva-1 homolog A (C. elegans)
  Uniprot ID: Q9H8M9
  ENST ID: ENST00000393913
  CDS Start-End: 426-884
cggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctctttggagacaagaaaattttattatgactctagataattgtgattttaaacactttgtttttttttttttttttaattggatttcaaagaaaagaatggaaatgagaggtaaggattaaagccaaagttaggatgggaattaaaaaaataaacattacataaaatctt

SEQ ID NO: 131405 - DNA, 1747 bp, Homo sapiens
  Payload ID: 5644
  Gene Symbol: EVA1A
  Gene Name: eva-1 homolog A (C. elegans)
  Uniprot ID: Q9H8M9
  ENST ID: ENST00000410113
  CDS Start-End: 539-997
ctgactcgggctcctgcagcttctgcggggcttggcgccgccgtccgtgagcacccaggccgggaccccacatccccaggccagccctgaccccggcggcccctccgccgggattcctttccgaggtactggtgccggcccaagacccgggcagcgctttgtcgtgtccgcccctcagtgatcagctccgggtccccctgctcggccccgcgcgccccaagcgcagtccccggaagtgcgcgccggggccccagcaaagtgcaggtaggtagatcgctgaccacatttgctcatttctggattattcattcaaaggaagcactatgagtcaatcattgggcacagagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatgaaaatgaatagaactattgtattatgggagatgtgtcagtgaactagaaaatgtcaataacctcaaaggatgaagggtttttattttaaatagtttataaaatatatattgacatgcatatttgaaaatgctgcataaaaataaaagtggtgtgttttccccctc

SEQ ID NO: 131406 - DNA, 696 bp, Homo sapiens
  Payload ID: 5644
  Gene Symbol: EVA1A
  Gene Name: eva-1 homolog A (C. elegans)
  ENST ID: ENST00000410010
  CDS Start-End: 112-534
attctcagtaaagacacactacgtaatcaaagctactgctctgctttgctgagctttgagatgaaaggtctccaggttgggagttaagcttgtcattctctaatttgaaaaatgaagggttctaagagctttgtcttgcagaaaatgtttagctgctcaaaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaacccagctctgctaatattgtgatttcagagaaaaagcaggacatgccccttttctagccaggaggattgctcctttttggc

SEQ ID NO: 131407 - DNA, 777 bp, Homo sapiens
  Payload ID: 5644
  Gene Symbol: EVA1A
  Gene Name: eva-1 homolog A (C. elegans)
  Uniprot ID: Q9H8M9
  ENST ID: ENST00000410071
  CDS Start-End: 234-692
cgggacaggaatgagaggatggatgctggcaggggcttggagagtctgagaagccaactggggccaaacaagttttagaacctctactggctgatgccaacatcatcagagatgaactgttcttaccagaaacttctctgctcctgacaccccacctctccccagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcccgggaccaggagcctgaatcgctactattagggagcagcaggaccccggaaaccactggaggccgcctggaaaggagagcgtctgcagggacagtgggcacaaggaactgaaccca

SEQ ID NO: 131408 - DNA, 434 bp, Homo sapiens
  Payload ID: 5644
  Gene Symbol: EVA1A
  Gene Name: eva-1 homolog A (C. elegans)
  ENST ID: ENST00000452003
  CDS Start-End: 132-434
gaacccgatgggctgtgcctcaaaggtgaaccagggagaatcaaataaagagttccagaagtgaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgc

SEQ ID NO: 131409 - DNA, 569 bp, Homo sapiens
  Payload ID: 5644
  Gene Symbol: EVA1A
  Gene Name: eva-1 homolog A (C. elegans)
  ENST ID: ENST00000432649
  CDS Start-End: 142-569
gagtagctgaatacaggctcaaagcaggcgacgggacaggaatgagaggatggatgctggcaggggcttggagaagagaagaaggagagtggccacgttgattcagccaagcacctccaggaggtcccctctggatgtcccatgaggctgcccctcagccacagcccagagcacgtggagatggctttgctcagcaacatcctagcggcctattcctttgtctcagaaaatcctgagcgagcagctctgtactttgtttctggcgtgtgcatcgggctggtgctgaccctggctgctctggtgataaggatctcttgccacacagactgcaggcggcgtcccgggaagaagttcctgcaggacagagagagcagcagcgacagcagcgacagcgaggatggcagtgaggacaccgtgtccgatctctccgtgcggagacaccgccgcttcgagaggactttgaacaagaatgtgttcacctctgcggaggagctggagcgcgcccagcggctggaggagcgcgagcgcatcatcagggagatctggatgaatggccagcctgaggtgcc

SEQ ID NO: 131410 - DNA, 1054 bp, Homo sapiens
  Payload ID: 5645
  Gene Symbol: EVA1B
  Gene Name: eva-1 homolog B (C. elegans)
  Uniprot ID: Q9NVM1
  ENST ID: ENST00000270824
  CDS Start-End: 293-790
attcaagcctgggccctggaaggaggggtggacagtcccctcccttccagtccagcatgggtctggggaagagaagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtg

SEQ ID NO: 131411 - DNA, 1998 bp, Homo sapiens
  Payload ID: 5646
  Gene Symbol: EVA1C
  Gene Name: eva-1 homolog C (C. elegans)
  Uniprot ID: P58658
  ENST ID: ENST00000300255
  CDS Start-End: 474-1799
gggcgaggctggcacccggccagcgcgggcagggccacgggtgcccggctgtttcccgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctt

SEQ ID NO: 131412 - DNA, 1668 bp, Homo sapiens
  Payload ID: 5646
  Gene Symbol: EVA1C
  Gene Name: eva-1 homolog C (C. elegans)
  Uniprot ID: P58658
  ENST ID: ENST00000382699
  CDS Start-End: 153-1469
aggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctt

SEQ ID NO: 131413 - DNA, 1558 bp, Homo sapiens
  Payload ID: 5646
  Gene Symbol: EVA1C
  Gene Name: eva-1 homolog C (C. elegans)
  ENST ID: ENST00000401402
  CDS Start-End: 170-1351
cctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctttgttttct

SEQ ID NO: 131414 - DNA, 936 bp, Homo sapiens
  Payload ID: 5646
  Gene Symbol: EVA1C
  Gene Name: eva-1 homolog C (C. elegans)
  ENST ID: ENST00000412833
  CDS Start-End: 477-936
tggagtgccagtacacaacatggattgcaccaggctgggtctaagataaaaccagactgtggacaacgggacagataaggcccacatggctctgcactgcctgggtctgttactgtgtggaggaatgtcttagtctgttgctcctgtgggtgtagctaaaacacgaaccaggagccttcatccttagaaaggagtcagacagacacctgagaaccaatcccaaactgcacccttcccctgaacctcgtggaaccttctggaatgcaacttattactgccagagggtctttgatgagagtctactctccactatttgtcttcattacccacatattctctttccgtggaaaggttacctaaccaaactcctgcaaaaccacaccacctatgcctgtgatggggactatttgaatctacagtgccctcggcattctacgataagtgtccaatcggcattttatgggcaagattaccaaatgtgtagttcccagaagcctgcctcccagagggaagacagcttaacctgtgtggcagccaccaccttccagaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcg

SEQ ID NO: 131415 - DNA, 1745 bp, Homo sapiens
  Payload ID: 5646
  Gene Symbol: EVA1C
  Gene Name: eva-1 homolog C (C. elegans)
  ENST ID: ENST00000437338
  CDS Start-End: 418-630
cgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctgaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctt

SEQ ID NO: 131416 - DNA, 1548 bp, Homo sapiens
  Payload ID: 5646
  Gene Symbol: EVA1C
  Gene Name: eva-1 homolog C (C. elegans)
  ENST ID: ENST00000457807
  CDS Start-End: 302-880
ctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctgatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgattgcttgtcttactcagctttgcaagtcctatcccgaaggtgctatgggaagcagagatgcaaaatcatcgtcaacaatcaccattttggaagcccctgtttgccaggcgtgaaaaaatacctcactgtgacctacgcatgtgttcccaagaacatactcacagcgattgatccagccattgctaatctaaaaccttctttgaagcagaaagatggtgaatatggtaatttttatggcttactaccagcatttctctttaagtaaaggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctt

SEQ ID NO: 131417 - DNA, 1601 bp, Homo sapiens
  Payload ID: 5646
  Gene Symbol: EVA1C
  Gene Name: eva-1 homolog C (C. elegans)
  ENST ID: ENST00000435323
  CDS Start-End: 418-630
cgggtgtggaaggcgctcaaggtgcgcggcccggggcgcgctactgggggcgccctccgcggtgggcagcgcgccagggatcggcctgggcagccgcggggcgcgcgaaggctgcgctttccctacggcccccctcgcttcctccggcacggcggcaacggagatttcctctcggggaaactacgcggatccttttcggggatcctcgccccgccccagttctccgccccctcccctttgctggggcgcctgggctggcccgcgcaggggaggaggctctggcagcctgggcagggaggcggcggggggccgcggagccgctggccatcgattctccccgccatgtgacgccgtccttagccctgcgacccccagcgcgtcccgggcctgcgcctccgccccgccgcgcagcgcacgatgcttctgccgggacgcgcacgccaaccgccgacgccccagcccgtgcagcatcccggcctccgccggcaggtagagccgccggggcagctcctgcgcctcttctactgcactgtcctggtctgctccaaagagatctcagcgctcaccgacttctctgaaggtgctggacgaatgccagaaccagcgggcctgccacctcctggtcaatagccgtgtttttggacctgacctttgtccaggaagcagtaaatacctcctggtctcctttaaatgccaacctaatgaattaaaaaacaaaaccgtgtgtgaagaccaggagctgaaactgcactgccatgaatccaagttcctcaacatctactctgcgacctacggcaggaggacccaggaaagggacatctgctcctccaaggcagagcggctcccccctttcgttcccaagaacatactcacagcgattgatccagccattgctaatctaaaaccttctttgaagcagaaagatggtgaatatggtataaacttcgacccaagcggatcgaaggttctgaggaaagatggaattcttgttagcaactctctggcagcctttgcttacattagagcccacccggagagagctgccctgctgttcgtgtccagtgtctgcatcggcctggccctcacactgtgcgccctggtcatcagagagtcctgtgccaaggacttccgcgacttgcagctggggagggagcagctggtgccaggaagtgacaaggtcgaggaggacagcgaggatgaagaagaggaggaggacccctctgagtctgatttcccaggggaactgtcggggttctgtaggacttcatatcctatatacagttccatagaagctgcagagctcgcagaaaggattgagcgcagggagcaaatcattcaggaaatatggatgaacagtggtttggacacctcgctcccaagaaacatgggccagttctactgaaaaccacatgcatcttgatgcgatcgcactttctgaagaaggaaggatcccaaatgcccctccagttctggttcacctgtaccttctatgaaggagaattcgtcatgtcattcaacactcgtgaggccaggaagctattaaagggatgtttcaagctgtttctagcacattccaaaataaatgaggagggaagagtctt

SEQ ID NO: 131418 - DNA, 1500 bp, Homo sapiens
  Payload ID: 5647
  Gene Symbol: EVX1
  Gene Name: even-skipped homeobox 1
  ENST ID: ENST00000222761
  CDS Start-End: 332-937
atccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataa

SEQ ID NO: 131419 - DNA, 2955 bp, Homo sapiens
  Payload ID: 5647
  Gene Symbol: EVX1
  Gene Name: even-skipped homeobox 1
  Uniprot ID: P49640
  ENST ID: ENST00000496902
  CDS Start-End: 332-1555
atccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatccggccgcaagaattggaaagcctaggaagtggcggtggctggcgcgtttggggagcaggagtggggatagggaagcagagcttgagagaccttcctccggggcagcctccggacccaccgccccccaccagggtcgaggctgtagctccaaagctaaacaaaacttagcagcaacagcaaccaatatccagtccctcggcccctcggcccctcaccctccacctcacactcccttctcaccgggccccctctccccagccaaggcccaagcactggaaagggaaattgctgtctctctgaacaaaatgctgtgtatgcagagcaggtagagattaatctttgccagcttttccaaggcatgacaaggggctggtggatggcaacataccagtcatttggaggagagagtgagagatgatttactaccagggagaatccagccccttggcatgggacctggagcctcgactacacagcatcttctgggtctggcgtctgccagcacctgatctctttcctcattcccagctttgtgacacttctcaacttgcggctccatctctccctgcccccacttttttgttggccagggaggctgcagatgccccaggagccctttgccgcttctatgaggccaagccttttttccctgggcccagcacacaccctgattagcaagtgatgtgtgcgaggagggtttgtgaatgttgaatgtgtaataatgatcaccatggagctggccactgaccccagagctgagctgttaacaaggcgcccagggaagagcttagggagtgggaacttcacctccctctctcggtatctggcggtaaattagaggcaattttcatcctttgcttgttcaccttcacttcaccaggaactttctggccctaccctttgcattgggtattttacaactttctctcattttcttcccaagctaccactggagcttgactttcagataccagtgggagccttctgtcccttttggggaccctgtctgtggcctccaccagggtttgtttagagccactcccaaatcctcactcccacactcatccttgcagccagtttttgaggaagaggagaacgtgtaaccccaatgcaagcttcaccctgactgagagggagtggttcttcctgtagggaatgaatttggtttgatttggggttttcctttgaagcccaaagaacttgctgttatgattcgttaaccatattgcaataaaagctggacataattctca

SEQ ID NO: 131420 - DNA, 1635 bp, Homo sapiens
  Payload ID: 5647
  Gene Symbol: EVX1
  Gene Name: even-skipped homeobox 1
  ENST ID: ENST00000580535
  CDS Start-End: 1-321
cggacaccgagtcggatttctatgaagaaatcgagcctccttcccataaccctcagaacaacctggactccactcacatatactaagggtccggctccgaggcgctggtcggcagtccgaacggagggagcgagacccccaagagcaacggcggcagtggtgggggcggctcgcaaggcaccctggcgtgcagcgccagtgaccagatgcgtcgttaccgcaccgccttcacccgagagcagattgcgcggctggagaaggaattctaccgggagaactacgtatccaggccgcggagatgtgagctggcggccgccctaaacctgccggaaaccaccatcaaggtgtggttccagaaccggcgcatgaaggacaagcggcagcgcctggccatgacgtggccgcacccggcggaccccgccttctacacttacatgatgagccatgcggcggccgcgggcggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggcccgcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatccggccgcaagaattggaaagcctaggaagtggcggtggctggcgcgtttggggagcaggagtggggatagggaagcagagcttgagagaccttcctccggggcagcctccggacccaccgccccccaccagggtcgaggctgtagctccaaagctaaacaaaacttagcagcaacagcaaccaatatccagtccctcggcccctcggcccctcaccctccacctcacactcccttctcaccgggccccctctccccagccaaggcccaagcactggaaagggaaattgctgtctctctgaacaaaatgctgtgtatgcagagcaggtagagattaatctttgccagcttttccaaggcatgacaaggggctggtggatggcaacataccagtcatttggaggagagagtgagagatgatttactaccagggagaatccagccccttggcatgggacctggagcctcgactacacagcatcttctgggtctggcgtctgccagcacctgatctctttcctcattcccagctttgtgacacttctcaacttgcggctccatctctccctgcccccacttttttgttggccagggaggctgcagatg

SEQ ID NO: 131421 - DNA, 4203 bp, Homo sapiens
  Payload ID: 5648
  Gene Symbol: EVX2
  Gene Name: even-skipped homeobox 2
  Uniprot ID: Q03828
  ENST ID: ENST00000308618
  CDS Start-End: 138-1568
caatttttccgcctccctccgaaagcgataataatatttagaggcgttcgctggggctgaatgagaattagccctaggcgcagcctatcattaggacgggacagcagggccactgtgacatttttaagaaagctgagatgatggaaagaataagaaaagagatgattctgatggagagagggctgcacagccctacggcgggcaagagattctccaatttgtccaactcggctggcaatgctgtgctcgaggccctggaaaattcgcagcacccggctcgcctaagcccgcgcctgccgtctgcccccctgcacagcgctctgggagaactccccgccaagggcaaattcgaaatagacactttgttcaacctgcagcacacgggcagcgaaagcaccgtctcctccgaaatctcctccgccgccgagagccgcaagaagccgggccattattcagaggcggccgctgaggccgacatgagcagcgacgtggaggtgggctgctccgcgcttcgctcccccgggggcctcggcgccgctcagcttaaggaaaacaatggcaaagggtacgcagagagcggctcggctgccggcaccacgacgtcggcgtcgggctcaggcctcggaagcctgcatggaggcagcggaggcagcggcgggagcgcggcgctgggtggctccggctctggcgcggatcaagtgcggcgctaccgtacggcgttcacccgcgagcagatcgcgcgcctggagaaggagttctaccgggagaactatgtgtcgcggccccgccggtgcgagctggccgcggcactcaacctgcccgaaaccaccatcaaggtgtggttccagaaccggcgcatgaaggacaagcggcagcgcctggccatgtcctggccgcacccagccgaccccagcttctacacctacatgatgacgcacgcggccgccaccggaagcctgccctaccccttccactcgcacgtgccgctgcactactacccgcacgtgggcgtcacggcggcggcggccgcggctgcagcctcaggcgcggcggccgcggcttcgtcgcccttcgctacttccatccggccactggacaccttccgcgccctctcgcacccctactctcggccggagctgctgtgtagcttccgccaccctggtctctaccaggctcccgcggccgccgcggggctcaacagcgcggcctctgccgcggcagccgcggcagccgcagcggctgcggcctcctcggcggcggcggccggcgcgccccccagcggcggctctgcaccctgctcgtgcctcagttgccacagcagtcagtcggcggcggcagccgcggcagcagctgccgcagccctgggttcccggggtggcggtggcggcggcggtggtggtggtggcggcggcggcgggggcgccggggccgggggaggctcggacttcggctgcagcgcggcggcgccgcgttccgagagcggcttcctgccctactcggccgcggtgcttagtaagacggccgtgagcccgccggaccagagggacgaggctccgctcaccagataactacgtcgccaccgccagggggccgcgcccgcctctctgagtgtgcccgggagtcccctgtgcgccccctgagccctccgcgcgttgcccgctgctgccgctgccgccagggggcgccccggggcgcgggaggccgaagggaacctgctccgaattgggggagaaggagcaggcgcaaaagcctggcgggcatccccctaaattatttctatttttgtatttgccacccagccgtctgcccttctctctcttttctggctcccgggacccactttccacctctgtcctgagcgcttggtttcccaaagaccaacccctcgccccctaagctagtcctggctgtgcactctcaggtccgggttgcttggctgaacggcgtggcccgaagcaacggagaaccacaacaaagacagagggggatgctgtgcgctggtgcttgggggcgggggaggagtcgccccggaggtttctcgctgctgctgtttttcttccttttctttcaacgagggtgggggaggtggcaaacgttctttcagcctgagcttattagggaccctgcccgaagagtgcgggagaacggaggtctgataaggccgggaggacggatggagagcgtgggcagcggtggttgtttgtgagattgtttactacgttcaggagcaaggcgggtagggatgtggccgccttccccgggaaggacaaagccgaggtgctggaaggggtggccgttgcgccgcctccttttcggtccaacacctttctctcttttggtctttggtttcagtgctgatggaatggaagcatcttgcatattttatgcaaaaagtgatggcaaaagaggttgccacggccagggaagggaaaggaagggagttggggtaggggtaagactgatagatcgctgtagtatttggagaggcgttttcagctcagttttccaactaccgggttccactcgatctgggaaatacttgaatctctagatatattaatattatcctaaagcatttccttagacacttttctaagttagaactctctatgtccctcgtccccttctctcctcgctttccttttcctcgggtgaaatggttcttggcatatttctcacgcatgtctattgcgccttcgcctctgcaaagccaccgctgggttgctgagacccgctctgccaacccggctactggaggggtttccttgaacttgaagaaaggtacatcaaaacccactagtgttaactgccacgtcaagtttgatgctaataatgtgcagattatgacgaaaattgccaatcatgctctctgatggacctcctttgaatgtggaattggagaaaagttccccgcacggagacctgctgtcaagtactaacaacccgctaagggaagtcattaggagagacggataagagactcggtacataaaacattgttcttggtgcatagaatgtatgttatttaatgttatctctgttacctgaagtgatttcgcagaagaaagccacgttcttatcatctcaattgccgattttcattttggtaacttggacgccctgggtagacttttctctgttaagttgatattccaccagtgtgaacagcctcattaaatcaagcccagatatttccataatgctccccgcagagccacttggctcctcacataatgagattttctgaagagttgaagccctaaaataacttgctagtgcatgtttagacccagcgaagtgggtatgtgtgtgtacgtgtattaaaatgtaggtaggctacctacatgtgtttgtgtatgtgtatatatatgtatatgtatgtatatgcatatatatatccgtgctcttaaatacatatgtaagagatacacacatattcatgtatacatacacattggcactattttctgtggtttatttcagatttgtgtcctgccatcatattgttattttaaagacactggattttaaaatatcatttcctaaatataggctttcagtaaacttttgaaagaattagttttccaggagaaattatttccatcaaatggaaaatacataaaggggaaacagtatttcgaaattcctggggtctattaaaatattaccataaaatattagagaactttccaatgaaatagcaatgatctaaaacttaagtttttgtttttgtttttaaaaacatgagactacttatgtaaaatattgattataccagctcttattcactgagtttacatttttaaaaatattaatatataatttaaggctaaataaaataaaccaaaatatggtaccctttatcagctttacctatttagattgttaaagtcctttgttatgatcagctaacagatgtatataaggtactttaggcagtaatgtttacatttcccccaaaaaatatatatgattgatgagaacgctggttggtaaaattaacataaattcatcatttgttgggtccattggatctggttattatattgaaataaaattgtaaataaagtcttcgtgctttaaatattgctggatgtatgaactcactgtaagatattttacaaatgtgcaataattataaagccttgtatattacgttatttattgtgtttggtcatgtaaaataaatgttatttaaatcaa

SEQ ID NO: 131422 - DNA, 3418 bp, Homo sapiens
  Payload ID: 5649
  Gene Symbol: ETAA1
  Gene Name: Ewing tumor-associated antigen 1
  Uniprot ID: Q9NY74
  ENST ID: ENST00000272342
  CDS Start-End: 131-2911
cttgcgcgcgccccaccgaccaaaatggcggctgccgttggtgcggggtgcggtttgtagtgctgttgccctactcatccctttgcaaaatgtgaaagaagaagcggctggtggaggcgggccataggcaatgagtcggcgaaggaaacatgatgacagccctagcccgaagaaaacgccgcacaaaacagtggcggcggaggaatgcggctcggtggtcgagccagggaggaggcggctgagatcggcccgcggttcgtggccctgcggggctagagaggggcctcccgggccagtgcggcagcgagagcagcctccgaccgccgccctgtgcagtaaaagtaaccccgaggaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgtagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacgaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagttagtagagactgtttttgtagttttactttcattaactgttgcttaaggtttttatacacttccagattttaattaatactttcatatttctaggaacatggttgatatgaaataaaggactttttatttgtaaggaaa

SEQ ID NO: 131423 - DNA, 1265 bp, Homo sapiens
  Payload ID: 5650
  Gene Symbol: EWSR1
  Gene Name: EWS RNA-binding protein 1
  Uniprot ID: Q01844
  ENST ID: ENST00000333395
  CDS Start-End: 20-1084
cgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaa

SEQ ID NO: 131424 - DNA, 2267 bp, Homo sapiens
  Payload ID: 5650
  Gene Symbol: EWSR1
  Gene Name: EWS RNA-binding protein 1
  ENST ID: ENST00000331029
  CDS Start-End: 47-1903
gcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtca

SEQ ID NO: 131425 - DNA, 2552 bp, Homo sapiens
  Payload ID: 5650
  Gene Symbol: EWSR1
  Gene Name: EWS RNA-binding protein 1
  ENST ID: ENST00000332050
  CDS Start-End: 329-2191
agagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagatatacttcgttgggtcggggagaacaaagaatggttttgaaaccagagctttcagttcccttcatggtttccagagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagag

SEQ ID NO: 131426 - DNA, 1989 bp, Homo sapiens
  Payload ID: 5650
  Gene Symbol: EWSR1
  Gene Name: EWS RNA-binding protein 1
  Uniprot ID: Q01844
  ENST ID: ENST00000332035
  CDS Start-End: 12-1814
aaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 131427 - DNA, 1289 bp, Homo sapiens
  Payload ID: 5650
  Gene Symbol: EWSR1
  Gene Name: EWS RNA-binding protein 1
  ENST ID: ENST00000360091
  CDS Start-End: 1-925
tcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtca

SEQ ID NO: 131428 - DNA, 2654 bp, Homo sapiens
  Payload ID: 5650
  Gene Symbol: EWSR1
  Gene Name: EWS RNA-binding protein 1
  Uniprot ID: Q01844
  ENST ID: ENST00000397938
  CDS Start-End: 320-2290
ggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtca

SEQ ID NO: 131429 - DNA, 2207 bp, Homo sapiens
  Payload ID: 5650
  Gene Symbol: EWSR1
  Gene Name: EWS RNA-binding protein 1
  Uniprot ID: Q01844
  ENST ID: ENST00000406548
  CDS Start-End: 65-2032
gcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 131430 - DNA, 710 bp, Homo sapiens
  Payload ID: 5650
  Gene Symbol: EWSR1
  Gene Name: EWS RNA-binding protein 1
  ENST ID: ENST00000455726
  CDS Start-End: 12-710
aaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccagga

SEQ ID NO: 131431 - DNA, 587 bp, Homo sapiens
  Payload ID: 5650
  Gene Symbol: EWSR1
  Gene Name: EWS RNA-binding protein 1
  ENST ID: ENST00000415761
  CDS Start-End: 48-587
agcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagc

SEQ ID NO: 131432 - DNA, 2189 bp, Homo sapiens
  Payload ID: 5650
  Gene Symbol: EWSR1
  Gene Name: EWS RNA-binding protein 1
  Uniprot ID: Q01844
  ENST ID: ENST00000414183
  CDS Start-End: 22-2007
aacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcg

SEQ ID NO: 131433 - DNA, 582 bp, Homo sapiens
  Payload ID: 5650
  Gene Symbol: EWSR1
  Gene Name: EWS RNA-binding protein 1
  ENST ID: ENST00000447973
  CDS Start-End: 85-582
gagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactgaagggaccagtacaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccag

SEQ ID NO: 131434 - DNA, 553 bp, Homo sapiens
  Payload ID: 5650
  Gene Symbol: EWSR1
  Gene Name: EWS RNA-binding protein 1
  ENST ID: ENST00000436425
  CDS Start-End: 85-553
gagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactgtagaagggaccagtacaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtc

SEQ ID NO: 131435 - DNA, 933 bp, Homo sapiens
  Payload ID: 5650
  Gene Symbol: EWSR1
  Gene Name: EWS RNA-binding protein 1
  ENST ID: ENST00000437155
  CDS Start-End: 56-933
agagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccg

SEQ ID NO: 131436 - DNA, 560 bp, Homo sapiens
  Payload ID: 5650
  Gene Symbol: EWSR1
  Gene Name: EWS RNA-binding protein 1
  ENST ID: ENST00000444626
  CDS Start-End: 329-560
agagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactc

SEQ ID NO: 131437 - DNA, 2446 bp, Homo sapiens
  Payload ID: 5650
  Gene Symbol: EWSR1
  Gene Name: EWS RNA-binding protein 1
  ENST ID: ENST00000629659
  CDS Start-End: 329-2083
agagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccagcaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtc

SEQ ID NO: 131438 - DNA, 1278 bp, Homo sapiens
  Payload ID: 5651
  Gene Symbol: ERCC1
  Gene Name: excision repair cross-complementation group 1
  Uniprot ID: P07992
  ENST ID: ENST00000013807
  CDS Start-End: 193-1164
gggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggca

SEQ ID NO: 131439 - DNA, 3828 bp, Homo sapiens
  Payload ID: 5651
  Gene Symbol: ERCC1
  Gene Name: excision repair cross-complementation group 1
  Uniprot ID: P07992
  ENST ID: ENST00000300853
  CDS Start-End: 593-1486
gggaacgtgtctgtgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcatcttgctgtttttctttcttcgtcttctttttgggagctgccagagctgcctgggcctgaggcttcgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagtagtttccaataaacttgtttctttcactgtgc

SEQ ID NO: 131440 - DNA, 949 bp, Homo sapiens
  Payload ID: 5651
  Gene Symbol: ERCC1
  Gene Name: excision repair cross-complementation group 1
  Uniprot ID: P07992
  ENST ID: ENST00000340192
  CDS Start-End: 67-888
ggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctc

SEQ ID NO: 131441 - DNA, 3119 bp, Homo sapiens
  Payload ID: 5651
  Gene Symbol: ERCC1
  Gene Name: excision repair cross-complementation group 1
  Uniprot ID: P07992
  ENST ID: ENST00000423698
  CDS Start-End: 101-778
acatctctcacgataaatgagtggggagaacttatagcccttgaagtcaaccatctcacacctttccaaaggacgcgaccataactctaaaaggctccagatggaccctgggaaggacaaagagggggtgccccagccctcagggccgccagcaaggaagaaatttgtgatacccctcgacgaggatgaggtccctcctggagtgaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcatcttgctgtttttctttcttcgtcttctttttgggagctgccagagctgcctgggcctgaggcttcgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagtagtttccaataaacttgtttctttcactgtg

SEQ ID NO: 131442 - DNA, 556 bp, Homo sapiens
  Payload ID: 5651
  Gene Symbol: ERCC1
  Gene Name: excision repair cross-complementation group 1
  ENST ID: ENST00000587888
  CDS Start-End: 1-138
tttggcgacgtaattcccgactatgtgctgggccagagcacctgtgccctgttcctcagggcccctggcacctgttctccccttgaagcccaagtctcttcccctcttcatgaagaagccaggggtctggtcttctagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaa

SEQ ID NO: 131443 - DNA, 449 bp, Homo sapiens
  Payload ID: 5651
  Gene Symbol: ERCC1
  Gene Name: excision repair cross-complementation group 1
  ENST ID: ENST00000592444
  CDS Start-End: 1-337
gtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctggg

SEQ ID NO: 131444 - DNA, 674 bp, Homo sapiens
  Payload ID: 5651
  Gene Symbol: ERCC1
  Gene Name: excision repair cross-complementation group 1
  ENST ID: ENST00000589214
  CDS Start-End: 250-674
gagattacaggcgggagccaccgcgcccggcccagttctggggttttttgtgtgtgtggaagtcccacttctgatccaacctcagtctctcatgctgcagatctttcctttgctgtacatccatccacagcctctccagcggagacttgggatgtcccaccaaaaaaggtgcccgggaggacgcggagtaggggctaggcgcctccactgccccccatccgggggcctccgcttggggccgggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcag

SEQ ID NO: 131445 - DNA, 345 bp, Homo sapiens
  Payload ID: 5651
  Gene Symbol: ERCC1
  Gene Name: excision repair cross-complementation group 1
  ENST ID: ENST00000590701
  CDS Start-End: 1-275
acaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggc

SEQ ID NO: 131446 - DNA, 938 bp, Homo sapiens
  Payload ID: 5651
  Gene Symbol: ERCC1
  Gene Name: excision repair cross-complementation group 1
  ENST ID: ENST00000592083
  CDS Start-End: 165-938
ggcgcgatctcggctcactgcaacctctgcctcccgggttcaagcgattctcctgcctcagcctccacagtagttgggattacaggatcacgtgataaggcactagcagatgtggttggaatccttgctgtgctgaatcctggctgtgtgaccccaagctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttgga

SEQ ID NO: 131447 - DNA, 1453 bp, Homo sapiens
  Payload ID: 5651
  Gene Symbol: ERCC1
  Gene Name: excision repair cross-complementation group 1
  Uniprot ID: P07992
  ENST ID: ENST00000589165
  CDS Start-End: 553-1446
ctgggaacgtgtctgtgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgacccc

SEQ ID NO: 131448 - DNA, 836 bp, Homo sapiens
  Payload ID: 5651
  Gene Symbol: ERCC1
  Gene Name: excision repair cross-complementation group 1
  ENST ID: ENST00000591636
  CDS Start-End: 128-769
gacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggaggcccggaggctgtttgatgtcctgcacgagcccttcttgaaagtaccctgatgaccccagctgccaaggaaacccccagtgtaataataaatcgtcctcccaggcca

SEQ ID NO: 131449 - DNA, 738 bp, Homo sapiens
  Payload ID: 5651
  Gene Symbol: ERCC1
  Gene Name: excision repair cross-complementation group 1
  ENST ID: ENST00000592023
  CDS Start-End: 37-738
aggggcggagcgatgggacttgtggacctgctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgg

SEQ ID NO: 131450 - DNA, 738 bp, Homo sapiens
  Payload ID: 5651
  Gene Symbol: ERCC1
  Gene Name: excision repair cross-complementation group 1
  ENST ID: ENST00000589381
  CDS Start-End: 112-738
gctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtgaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaa

SEQ ID NO: 131451 - DNA, 2871 bp, Homo sapiens
  Payload ID: 5652
  Gene Symbol: ERCC2
  Gene Name: excision repair cross-complementation group 2
  ENST ID: ENST00000391941
  CDS Start-End: 754-2871
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgg

SEQ ID NO: 131452 - DNA, 2334 bp, Homo sapiens
  Payload ID: 5652
  Gene Symbol: ERCC2
  Gene Name: excision repair cross-complementation group 2
  ENST ID: ENST00000391944
  CDS Start-End: 48-2096
ttcatgagggaggcgggtcgaccccgctgcacagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgagatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcc

SEQ ID NO: 131453 - DNA, 4153 bp, Homo sapiens
  Payload ID: 5652
  Gene Symbol: ERCC2
  Gene Name: excision repair cross-complementation group 2
  Uniprot ID: P18074
  ENST ID: ENST00000391945
  CDS Start-End: 79-2361
ggatgtccacgacccggcctctcgctgaatattcatgagggaggcgggtcgaccccgctgcacagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcagggctctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgcca

SEQ ID NO: 131454 - DNA, 1538 bp, Homo sapiens
  Payload ID: 5652
  Gene Symbol: ERCC2
  Gene Name: excision repair cross-complementation group 2
  Uniprot ID: P18074
  ENST ID: ENST00000485403
  CDS Start-End: 220-1437
gagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggccaggctcagcactgtggaagcagcaggaaccaaaaaagatctcatccctaaccccccagaacttatattccagatgggaaaaccagtagcaaagatgcagccaaataaacaaggaaataattccagaaagtgacagttatcatgaaaaaaaa

SEQ ID NO: 131455 - DNA, 1007 bp, Homo sapiens
  Payload ID: 5652
  Gene Symbol: ERCC2
  Gene Name: excision repair cross-complementation group 2
  ENST ID: ENST00000586131
  CDS Start-End: 131-1007
gagaagggggctgggggtcgcgctcgctagcgggcgcggggggtcttgaagatggggtcatcggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcagg

SEQ ID NO: 131456 - DNA, 557 bp, Homo sapiens
  Payload ID: 5652
  Gene Symbol: ERCC2
  Gene Name: excision repair cross-complementation group 2
  ENST ID: ENST00000591309
  CDS Start-End: 18-401
acagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgagacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccggg

SEQ ID NO: 131457 - DNA, 817 bp, Homo sapiens
  Payload ID: 5652
  Gene Symbol: ERCC2
  Gene Name: excision repair cross-complementation group 2
  ENST ID: ENST00000587376
  CDS Start-End: 1-608
gggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggag

SEQ ID NO: 131458 - DNA, 690 bp, Homo sapiens
  Payload ID: 5652
  Gene Symbol: ERCC2
  Gene Name: excision repair cross-complementation group 2
  ENST ID: ENST00000586856
  CDS Start-End: 364-690
gggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaaggcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgag

SEQ ID NO: 131459 - DNA, 2750 bp, Homo sapiens
  Payload ID: 5653
  Gene Symbol: ERCC3
  Gene Name: excision repair cross-complementation group 3
  Uniprot ID: P19447
  ENST ID: ENST00000285398
  CDS Start-End: 96-2444
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagt

SEQ ID NO: 131460 - DNA, 2920 bp, Homo sapiens
  Payload ID: 5653
  Gene Symbol: ERCC3
  Gene Name: excision repair cross-complementation group 3
  ENST ID: ENST00000445889
  CDS Start-End: 14-229
tgctgtagctgccatgggcaaaagagaccgagcggaccgcggtgagacgttgcgcgggcacgctcagccacgactgcccttgccggccctgccccccgctctgcctcggagctgctccgggcctctgcgccggccgaccctgctggccctcccgcgcgcaccccgttgggacaggcctttgggcgggagagatgctggacctgggcgcagcccagcgaactcggcctaggggagacgggtgaggggcgcaacgcctgcgggatgcaggtggctcttagctaggagtttgcggcggcgcagacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattg

SEQ ID NO: 131461 - DNA, 563 bp, Homo sapiens
  Payload ID: 5653
  Gene Symbol: ERCC3
  Gene Name: excision repair cross-complementation group 3
  ENST ID: ENST00000456257
  CDS Start-End: 1-563
agttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgcccacctacctctctcacagatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcatt

SEQ ID NO: 131462 - DNA, 2916 bp, Homo sapiens
  Payload ID: 5653
  Gene Symbol: ERCC3
  Gene Name: excision repair cross-complementation group 3
  ENST ID: ENST00000426778
  CDS Start-End: 65-280
cagagcggatgccgcggcgggcctgtgggagcggggtcatcttctctctgctgctgtagctgccatgggcaaaagagaccgagcggaccgcggtgagacgttgcgcgggcacgctcagccacgactgcccttgccggccctgccccccgctctgcctcggagctgctccgggcctctgcgccggccgaccctgctggccctcccgcgcgcaccccgttgggacaggcctttgggcgggagagatgctggacctgggcgcagcccagcgaactcggcctaggggagacggacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccagt

SEQ ID NO: 131463 - DNA, 6758 bp, Homo sapiens
  Payload ID: 5654
  Gene Symbol: ERCC4
  Gene Name: excision repair cross-complementation group 4
  Uniprot ID: Q92889
  ENST ID: ENST00000311895
  CDS Start-End: 10-2760
agagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagaagccaggattcctctctgaactctgcagttaggcatcacttgaacttgcctgtgcctgctctttttcctccctgcaccgtctatgccgggcttagcatgtttctttttaaatgaggtttgtcaggatcaggtaaagttcctacaagtgattacagaaggtagaaactttacctgatcctaacagatctcatttagaaaggaatatgctaagcctggcatggacggtgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactagtcttctaatgaccctaacatatgtagcatatactataatttcattgttccaaattagtatttttaaagcaaaatgaattacctgtttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatcctctagaaatacaacctaattggcagtgagccgagatcgcaccactgcacccctgcctgggcgacagagtgagactttgtctctattacaaaaagaaaagaaaagaaatacaacctaagctcacctgcctgtgattcctcatttctcaccatcctgtgccagggtggctacttctctctgtgaggactcaaatacaagccaatgagtggcccactaagcttttaagatttgattttcctgccttgagataaaaaggagtgtaggtaaatgaaagatcaatgtatggaatatataaaaatacgaaagaaatatatacgtttaaaaatccataaagaaaaaaatctcattctaaacctgattaagttggctttttacgtaagtgtacaaataggatattcacagcatctttgtgcagtttttaaacttttatatttaaacattattaagttggcttttgttcacatgttgagtaatgggtagtaaattttctacctcaggagctgatatagacatcagttctgctagccatatcacatattttaatgtttcatcaacatcagctgtttttttgtttgctacactatttgaactaatagacagtggatcatgtaacacaaaattgtcttcaactttaacaaaattgtcattgttatttttttttgagacagagtctccctctgttgcccaggctggagtgcagtggcgcaatctcggctcactgcaacctcgcctgctgggttcaagcagttctcccacctcagcctcccaagtagctgggattataggtgtgcaccaccagacccggctaatttttgtatttttagtagagacggggtttcaccatgttggccaggctggtctcaaactactgacctcaggtgatccacccaccttggcctcccaaagtgctgagataacaggcgtgagccaccgcacccacccaacaaaattatttttaactgtcgtttctgaactgaacctctcacattggcatcttgatttattggtacttaacagtatatatggattttgaactctacacaagggtataaccagaatgaattgaggggtatcaagaaccagattggttacagtagaactctgtaagatgatgtggagagtaaggaaaaggagaagaaataaaaattagtttaagatggaataaagatttgggctgctaattttttcccaggattcaaaatatacccgctagaatggaaaacaaaaatttgaatgattacaacattatcgttaacattcaattttgtatttattgttttattgaatatagttcagagtatattaaaatagacctaccacttcaaatgataatgattattataatgtctcttcaccctattctagcacttctgcttgcagtatgtggtttctatttttttcctcttgtataattccacttgcttttaattgttgtttcattatataaaaggaacatcttcccatagcatattctatgaaaggggtttcattccaagttgagttttcaaaaaaaaggtcttcctaaagctaccattttcaaccgtccttgttatctagtacaacataaataacagtcttaaaaattgcactaataccagtgcccccctggctctccaaatctgttctttgctcttgtatctgctggacgcttgaagacaggtgcactgtctcgtatgtatttgaattatgaacagtaatttctaatgaattctaaaatggtcattgtaagtgaaagcctctcgctaccacttcctcttccaactacataaatatatttcaatgtatttccagttttggaaagttttcaatacatacatcaagtgtttacttagatttttataaaaattttttttacaatctaataatctttggtaaaggaactagagatgcatgcagttgcaaaattaatgtatttattttccagcataattttattaacttcactttttttctctctagtaaatatccagtgtacttatgaactcatgtttggctcttttaaaaccttttctaaaagctagatcagcatttttctattttacaagttttttgtataaaaaggtgaacatatgagatattgtgagaaatcattttaagtttcatttaaatcatggtgcctcttttgatactttcttaaaattgtgcaagaagaaatcatttttagtagtggtcataaatattatccttttggcagtaagctattactaattcagcctgaagctcggtagacaatatgtctacatgtgtttgagtacatcctggatacagtttcccagctcatgagggactgaaaatagtcttattcatcaacccactaggatgtgaagggttaagtctagatttggtcgcattgaaaccccacaatatagaattaataaatggccttcagtaggaaaacctacactaaagcaaatccgaagaagtggggcagggggaaagaggcattactggtctttccttttgttttgcaagcataatttgattttcctttggctcagaaaactcatttggggaaattctcttttgtgttcagtttaacctagaaaggtcctcttgaaaaaccaacattttaggaaagttcttttttcaggatggagtatattaaaattaagccaggctttgacgtgaattatcacttttctttattattttgttttctattttggtttatagctatttctggttcagttctgaacttcagcacttaatcatccttatcaaccaggcttttggtagcctaaaccgctatgctgttgtttttttaatttaaagatgtataagccaaaatttggatgggagtgagacataactgatttatatgaattttaacagagttgtatttgtgtgtgtttaataaaatatatatttattcagtactttcctcagtattttatgggcaaagtaaaaataacaatgcatagtgaaagggcatatattaccagcagtaataattcaaaatcctgaaaatgtttcattttttttgtttttgttatgcagaataaacaaggcagaaatgctctttgaacc

SEQ ID NO: 131464 - DNA, 2073 bp, Homo sapiens
  Payload ID: 5654
  Gene Symbol: ERCC4
  Gene Name: excision repair cross-complementation group 4
  Uniprot ID: Q92889
  ENST ID: ENST00000575156
  CDS Start-End: 10-1128
agagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaaggtatcttgtggggttaagtctttaaatgtgttttttatttcggtatttggtatggaaatttaaagtgcaatttaaagtcttctttggccatgtgaaaagtgtgttccttgaagataaatgtatgtatgtttgttatatgtaacatgtaatgtatgttgaaagtatatatgtaaagtatatgtgtaatgtatgtcgaagtatacagcatggcaagtcttgcagtctattgcccagggcttccaaataacagatgtcaaatattgatcaaaagtatgctacatgaggagctatatattgatttttttagaacttcaaagtaattattatttttgagtcagaatgaggttggggcatggtggcacacacctataatcccagccctttgggaggccgaggcaggaggattgcttgagcccgggagttcaagaccatcctgggcaacaaagcaagactccatctctacaaaaaaaattttaaggctgggctcagtggctcacgtctgtaatcccagcactttgggaggctgaggcaggccgatcacctgaggtcaggagtttgagaccagcctggccaatatggtgaaaccccgtctctattaaaaataccaaaaattagccaggcgtggtggcgggcacctgtaatcccagctactcaggaggctgaggcaggagaatcacttgaacccaggaggcggaggttgcagtgagctgagatcacactactgcactccagcctgggcaacagagtgagactcggtctcaaaaaaaaaaaaaaaaaaaaaacacaaaaacttttaaagtagcctggcgaggtgatgtgcacttatcgtctcagctacttgagaggctaaggtgagcccaggagttgaaggtgacaccaagatatgatcacaccactatactccagcctgggtgacagagtacgactgtgtctcaaaactaataaataaagtcaggatggaa

SEQ ID NO: 131465 - DNA, 721 bp, Homo sapiens
  Payload ID: 5654
  Gene Symbol: ERCC4
  Gene Name: excision repair cross-complementation group 4
  ENST ID: ENST00000462862
  CDS Start-End: 1-108
agggtttactttcttatatacggaggttcaactgaggaacaacgctatctcactgctttgcggaaagaaaaggaagcttttgaaaaactcataagatctaccgtataagatatgagccaccttgaagacaggaattcttgcgtgatcacgattatatccaaagtacctagagcaccacgcaggaacactccataaatgtttttcaataaatgcatgaggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtg

SEQ ID NO: 131466 - DNA, 583 bp, Homo sapiens
  Payload ID: 5654
  Gene Symbol: ERCC4
  Gene Name: excision repair cross-complementation group 4
  ENST ID: ENST00000574194
  CDS Start-End: 1-227
ccccctcaggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagt

SEQ ID NO: 131467 - DNA, 5082 bp, Homo sapiens
  Payload ID: 5655
  Gene Symbol: ERCC5
  Gene Name: excision repair cross-complementation group 5
  Uniprot ID: P28715
  ENST ID: ENST00000355739
  CDS Start-End: 1424-4984
tttgccaacgttaaggacgcgcagctgtgacacagccccaggaagtccagatgacatgtgcccaaggtggttggggcacagattggttttatacattttagggagacaggagacatcaatcaacatatgtaagtacactggttccttccagaaaggtggggacaactcggaagcaggaagggcttctaggtcacaggtagatgagagacaaaaggctgcatacgagtttctgataagcctttccaaaggagacaatcagaatatgcatctatctcagtgagcagaaggatgactgactagaatgggaggcaggttttgccctgagcagttcccagcttgacttttcccttttgcttagtaattttgggaccctaacattttcacaggctttaaattttattattctttagttactacgtgctagcatataaataaatagtacaaaaccaagaaggcatccaccttttggttgtctcttcacgtgtaaaacaacactttgtgttaagtatcttcacacacggcggcgcaaaggtagaaaccgatactaaaaaagcgtgtagaaaatagttcccagcctgggcaacacagggagacctcatttctacaaaaataattcgccaagcatagtggtgcgcacctgcggtcccagctacttgagaggctgagatgggaaagttgcttgagctcgggcagcaggagttccaggctgcagtgagctaagaatgcgccactggactccagtatgggcgacagcgtgagaccctgtctcaaacaaaaacaaaagcccgttactccaccaagaaggcgcttttgcacattgttttaatgcttaacgccttcaggatgccagcgtgacggaagcaagtaaccaccaaggcatcaccactggcgctaaacttctcacttccggagtgctgcaagcgcagaaaatatacgtcatgtgcggaggcggagcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtctttgta

SEQ ID NO: 131468 - DNA, 2986 bp, Homo sapiens
  Payload ID: 5655
  Gene Symbol: ERCC5
  Gene Name: excision repair cross-complementation group 5
  Uniprot ID: P28715
  ENST ID: ENST00000375954
  CDS Start-End: 1647-2906
caccacaagctggatgtgagtgtgcttatggatcctgaggtataactgtctcaggccttttcagcaacagtgccaggaagtatatttatgtatacatatacatgcacacacacatctatatttatttctatgtctatctgtactaaaatccatgagtttatactgacatctgcaattccatggggttcagtctagcctcctgcttctttatagtttccctaacaatgagaaacattgctccccttatcctcaatacatttacatctgcttattctccctggatatgtaaccatctccccctcccactggcctcctccttggccctgctctcttctttgcttcagctgtgtccttggtgccagctcccagtccctgagagccccctcctctgttctgattgtctccttaaacccagctggacaggccttgccagccctctccacctacagggaaggaaggcaaccattaaatatattttaaggagaaggaaagacagtaagacagtaagagaggagagaagggaagtggaagaggaagaactatttcttagtcacagctttattctgtgctgtgtaaatagcataaaaacatactgagcaacttccatgattgtttatatactttgataatcctcctttttgaatttttaaaacaatgtcagttaacttagaacatatttatataaagcgaatatacaaatcttaagagagtttcctactttcaaagacagtgccagtttacctaattgaaaaggcttgttttgaagttacaggcatttgtgattacatttatttattaataacgctactattacatgtattctgttatagtcatatctttcctttttaggatgtagcatttttcaggttcctccagaaagctcttgatgattgcaggatcattttaatgttttgattgtagatgaagtgaccttttaattttggtacaggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggtaataccgtaacattgtgtttcgacttcttgctgaggaagccaggttaagtaggttttgagttttaaggagttggtggatgagtatttagtagctatttgcagtacatcttgtggttgctgatggcttcatttttgtgtaggttactggctgggatagactccgttttccatgtggtttagtgatgaatctctaaagatattacagagtcttggttagacatccagtggagtacttcctaaggagaaagagcttattggtaatttcagtcagactaaatgcaggctttttgtaaacaaaactcatttggattattaatataaatctataaatgaaaaaacattttataggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaact

SEQ ID NO: 131469 - DNA, 635 bp, Homo sapiens
  Payload ID: 5655
  Gene Symbol: ERCC5
  Gene Name: excision repair cross-complementation group 5
  ENST ID: ENST00000472151
  CDS Start-End: 219-350
cagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcagactatacttgtagcaagcagaaacatcgatctaatacaagacagatgcacatcaacaccaagttctacctctgagatatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaag

SEQ ID NO: 131470 - DNA, 1125 bp, Homo sapiens
  Payload ID: 5655
  Gene Symbol: ERCC5
  Gene Name: excision repair cross-complementation group 5
  Uniprot ID: P28715
  ENST ID: ENST00000535557
  CDS Start-End: 427-1125
atttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggtatatcttcctctgctgcagccctag

SEQ ID NO: 131471 - DNA, 3660 bp, Homo sapiens
  Payload ID: 5655
  Gene Symbol: ERCC5
  Gene Name: excision repair cross-complementation group 5
  ENST ID: ENST00000610537
  CDS Start-End: 11-3568
cagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccaggaataccaactgtgggttgtgtaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtc

SEQ ID NO: 131472 - DNA, 8008 bp, Homo sapiens
  Payload ID: 5656
  Gene Symbol: ERCC6
  Gene Name: excision repair cross-complementation group 6
  Uniprot ID: Q03468
  ENST ID: ENST00000355832
  CDS Start-End: 80-4561
tgggttccaaggcggctggcggcggtagcgtctctgtttccttgtgggcgctcgcgcggccctgggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggagatggaataaactgagactgcaggacaaagagaaacgtctgaagctggaggacgattctgaggaaagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacagactgctgctataatgtcattttcccattcttcctttactaataaaatttttgagttttacctggacgtctggctgctcagcttaagactacttctcagcctctcttatagttaattgtggccatatgactaagttttaaacttcccaattggccctttaaagaagcagggtatgcactctccttgacattcccctttcttgctggctgggaggccaatgggagcttcagtagtgacctggcatctcaagagatggaagtgatgtgttgaggaaggagaagttggcctgccagtcttgaactgctctcctttgacctgttatttaagagtaaaataaaatactgacttgcttaagctactgtcttttgaagtctattatagcaattagtttgctttaaatatgtaatttatattaatggccttataccatccttattttgcaactaacttttcatttaatattatatgcaagacatttctattcctgtaagtatagctctgcctgcacagaattgttggattaatgatgtagattttaaatgtcagtggatgtagcagaattgcttgcatcaattcaccctccataaaaggacccatttctccaaacccttgccaacagtaagtggtatcaatatcgataggttgttttgttttgttttaaccagtctcgtgattgaaagtaccttgttttcacttgaatttccctgattacgtacaaaatcaaacatttccatgtttattggccatttgtagatctctaccgtacattgcctattagtgttatgttggcctagttttcctgtgggttgtttatcttttaggattgctcccctaaacaaaaacaaaaaggcagttattccaatgatcaacaaatattcttttctccaccagtttaaaatgtcagctttcaactcatcacatgctaagttgtctatttctgtcctgtggatccaggtgttggttctaccaaccacactcctcacgctgtcatttggtgctttgcattgtgttttgccattcatgggcaagttccttttcctttctccccctcttcagtgtcttatacttgggtgttttctgttccagctgaatcaagaattagtttattaaattccagtaaaattgtggtgttctttt

SEQ ID NO: 131473 - DNA, 660 bp, Homo sapiens
  Payload ID: 5656
  Gene Symbol: ERCC6
  Gene Name: excision repair cross-complementation group 6
  ENST ID: ENST00000462247
  CDS Start-End: 122-660
aggtgcgcgcgtggcggagggggaacagagaagcaggacagctctccatccttcccgtgttcagtcgtgggagacaacaagagaggtcacagcctggcgaccaaaaagtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataa

SEQ ID NO: 131474 - DNA, 5761 bp, Homo sapiens
  Payload ID: 5656
  Gene Symbol: ERCC6
  Gene Name: excision repair cross-complementation group 6
  ENST ID: ENST00000624341
  CDS Start-End: 1-233
ttgattccaaagaagtttacaggattctcaatggagagatgcaggaggttcttcagtcattcacatctattcatctccatgaatctccccttaacttcttcaggtctttccaagttagggggtctagatcacactatccaggaaagggaatgcaaactacacttggaattgtaaattttctagtagtcacattaaaaaggaaaaagagaaacagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacagactgctgctataatgtcattttcccattcttcctttactaataaaatttttgagttttacctggacgtctggctgctcagcttaagactacttctcagcctctcttatagttaattgtggccatatgactaagttttaaacttcccaattggccctttaaagaagcagggtatgcactctccttgacattcccctttcttgctggctgggaggccaatgggagcttcagtagtgacctggcatctcaagagatggaagtgatgtgttgaggaaggagaagttggcctgccagtcttgaactgctctcctttgacctgttatttaagagtaaaataaaatactgacttgcttaagctactgtcttttgaagtctattatagcaattagtttgctttaaatatgtaatttatattaatggccttataccatccttattttgcaactaacttttcatttaatattatatgcaagacatttctattcctgtaagtatagctctgcctgcacagaattgttggattaatgatgtagattttaaatgtcagtggatgtagcagaattgcttgcatcaattcaccctccataaaaggacccatttctccaaacccttgccaacagtaagtggtatcaatatcgataggttgttttgttttgttttaaccagtctcgtgattgaaagtaccttgttttcacttgaatttccctgattacgtacaaaatcaaacatttccatgtttattggccatttgtagatctctaccgtacattgcctattagtgttatgttggcctagttttcctgtgggttgtttatcttttaggattgctcccctaaacaaaaacaaaaaggcagttattccaatgatcaacaaatattcttttctccaccagtttaaaatgtcagctttcaactcatcacatgctaagttgtctatttctgtcctgtggatccaggtgttggttctaccaaccacactcctcacgctgtcatttggtgctttgcattgtgttttgccattcatgggcaagttccttttcctttctccccctcttcagtgtcttatacttgggtgttttctgttccagctgaatcaagaattagtttattaaattccagtaaaattgtggtgttctttt

SEQ ID NO: 131475 - DNA, 2932 bp, Homo sapiens
  Payload ID: 5656
  Gene Symbol: ERCC6
  Gene Name: excision repair cross-complementation group 6
  ENST ID: ENST00000623115
  CDS Start-End: 314-2905
aaaatgagattttaggtagacatacctataggtaccagatagtaagtatttggacagcaaaacaacaaaactatcttcttttaaggtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagt

SEQ ID NO: 131476 - DNA, 546 bp, Homo sapiens
  Payload ID: 5656
  Gene Symbol: ERCC6
  Gene Name: excision repair cross-complementation group 6
  ENST ID: ENST00000623318
  CDS Start-End: 194-546
agattaaataaaaccagttaaatgagctgaagtccaaaatgagattttaggtagacatacctataggtaccagatagtaagtatttggacagcaaaacaacaaaactatcttcttttaaggtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggagaaactaattcgagatgttgctcattgtcatggaattttgatcacatcttactcctacattcgattgatgcaggatgacattagcaggtatgactggcactatgtgatcttggacgaaggacacaaaat

SEQ ID NO: 131477 - DNA, 11026 bp, Homo sapiens
  Payload ID: 5656
  Gene Symbol: ERCC6
  Gene Name: excision repair cross-complementation group 6
  ENST ID: ENST00000623073
  CDS Start-End: 5858-6088
gtttaaggggctttgttgttttatgctgtgactatcatatctttagaacagaaatagtaattataaatctattttttgttacatagtattgcggttgtgaagacactcaattatattgaaatttttactgaatcttttctaggactaatttcatgtcttacgaaccagcagagaaattttcccttagggtatgccagaagaggagcaagtagttttgataatgaaatgagaccttaaagaaatatttctagagcagctataataatttacataagaaatgaattgagatggctggagaagagaattgtttttcctctttgaatatcagtgttttgggtaataatggcagcattaacctaagagaccgttctaatttgcctgttttttcttgtacattatcaggagctatctttttaaatctgtcttgtgatcaaaataatggaaatgtgatttttattttcatggtaggagatggaataaactgagactgcaggacaaagagaaacgtctgaagctggaggacgattctgaggaaagtgatgctgaatttgacgaaggttttaaagtgccaggttttctgttcaaaaagctttttaagtatgtaccatatgttctttcctttctatttgctatcaagccattatgtacaaattaacattttaggaattacatagtagttacctgtgggccctgaaggtacttgcagcaatttgttgcaaaaacagatactgtcaaatgaaattatagccacgtgctgttcattaaaattggatgataataagttgactaaaatgtgcattgggtatgtttgtaaactgatgaatctatatggacctgcctcagcagactaaaagcaacacatttaaaagccatttatgttgaataatttttttgttcttagtaattttaaggtgccaaactcctaatttcttaaataagattaataggaagagttgcatattaaaatcaatattgggaaggattttttttcttctatgtggaaataaaaaacttttgacattttttttgagtgtcttatattgtacctgagggtataatatttttgagctgaccaaatgtgcatctaaatattttatgtaggatgtcattctaatgtcaaaagagaagatatgggcaacaccttgatgattaagttgctatttgaagccaggtttcatgtgtaagtggccaagcattggagatgaccggatgctgcctgatagatgtgttcatgttgtctctaagggctggccagtctcccgtgatgaatgtaaatactgaggaacattttcagtctcgtcactcctgggatttacttaacaagatactttaggaaggcttcttagatgcatataggaagttaaaccattacatagcttctttctgtctcttttgtataatcaatttgtagttgggagcaggatgcaaagttctttgttcgagatgattaagtttggtctcctttatagattcagctgtcagccatgccctaaacttgtggaagaagtctacttaaaaacagcatgctctttatattttctctcaaagagcttatattatagttttaatttttctctccattggggtaggggagagtgaagagtagtttttttatcccactaaacattatagaaagccaaactctaaagatgtgaagtgacttgatgtgattgctttaactggacagaggaacagccgtgtagaagttgaaatctgaatctgtagtaatatttacagaggtggttgctttgtttattgcttctcccaaatgagaattaactatggaaaggtaaataaaggccacttttattggcaactctttttgttttctctacagtgattctttgttaagaaacaagccaaataccatcagtgttgtactagcaaaaggaatacccaaattatagattaaattgatttaaaaaagacaggatacttctgtgtatttgtagtaagtgatttggcagatatcctcaaggatcaagttgagtctgcatttttgtataaatgtcagattttctagcaaagatatttcacaattaatagtactaaactttgcttactaaaagtatttaggattcagtgtattaacaaaactctatagtagttaatataaataatattcgttttttaaaaattagtcttaattgcacattcctggaaagtattgtgtttttttaatctctgcaaaaacaggattttaaatattttatgtcataaaacttctgttcattttcttttgctgtatgaaaaaaattaataggattgatagagtctccatttttcttttatgattgcgttttagcggggccaatttaattttaaactgtagatatatttttttactgtatttgctgcattctgtggaattgaattgacagggtatagagttgtacacaagggagtcagaaggtacaattagccatttaagtacattttctgcaagatagtgtttaacttttaaatttctgttttgaaagtttgcccagcaagtatatttgtctatctaatttagcagtcaaatgacaaacttcaatcttttgaccttattttcagccacactagtaaatgcaatcttgggttagtgtggcaatgccaatgtacaccaattatttgtggtcacattgtgatgcctcagtctcaagggatagcagaataaatttttttatgttgtatattcataaaaatctttaactgtccctaaagagtaatttttatatgcttttcaaaaattttgaaaactagattctataatatgtttttatttaaactatgtaattggtttacactgtttattattaggaaggtaaagcaataaaaccaaagtcagttagtggcacagctgaaacctgagctcaggcccttatattcctcatctagcaacaccagctatgtatatcatctaccagctgtgtggctagtgcttttaatctgcaagtgaatttcctttaaataccatctgagggccttcgtgtattgtgtggaaagaaagagccactctttgctatctttgtaactatccctagtttttggggatcctgctagagatatgacttacatgctgcctagtaagattttttttaatgtcattttcttagtgctgttcatcttcttgtaaacacactcacatgctgtttgaaagccgtcgaagattagatttgtagatgaggaaacacccagcacattgtatgctgcctttcctgggccacacagaatctagttgtcttaaccccctctcaggttccttttgggatcctatgctgtttaccatttctttaataatttctcaactgctcctttccgcactctccctactttagttaagttgatgagccccaagcaaaaagagttgttggacccatgtaggatggaggcagtgtggtgtaggagtaatacactagaataatcactgggagattttgttccccgactggaggagctggtccagttgttctgtatctcagcaaaaagaggtcaactgactagaatgtagtgattctggaaactaattgcacatcagtttttttggagagctttttgcagtgtgtctttttcaaaagttgagattattctagtgtagccagttcatgaaccagcttttgttctaaatgagggtttctcgaccttgacacaattgacacttagggctaaataatttgttgctgtggggactgtcctgtgcagtatcagatattgaacagcttctctggcctctactattgcacttctctggttgtaacaaaaatgtctttagacattgccaaatgtcccatagggagaagaattacccctggctgagaactattggtctagatcatttccagaatcactttggaaacatacagttctggatttcagctctggcttgctcatttttttctagcgatgtcacctttggcaagttacctaaccattctgagcttttgtttcctaattataaagtgtgctgataatctcctttgtgcaagttgattgtgaggctgtgtccaaaccacctggcctggtgcctcctcagcagttggttccttaagtggtagccattattctctgattacataccacatattttcggaatttgtccttcttcccaaattaaatgatcttgtatctgtactacacttcatcgtgttttgatttttagttcttttctccaaggtgcatatccagtgtgtgtattataattagcaaacttaataagcagcaaagttctcatttagagttttccttatgtaataggtaataatggaacagctagagtcaaacttctagaattgctttgcaaaatactgggagaaagttaattatgacgtatttactgagaggagattaaataaaaccagttaaatgagctgaagtccaaaatgagattttaggtagacatacctataggtaccagatagtaagtatttggacagcaaaacaacaaaactatcttcttttaaggtgggtagcccatcagccttgatattttctttgaaaaaaaaatgccttatcttgcatcatctttttatttatttattagagatggggtctcactctgttgcccagtttggaatccggtggtgcaatcatggttcattgcagcctcaacctccatggctcaagcaatcctctcaccttagcctcccaagtagctaggactacaggcacgtgccaccactcctggctaaattttttttttttttcttgtagagatgaggtcttactatgttgcccatgctggtcttgaactcctgggcttaaatgatcctcctgcctcggcttcccaaagtgctgggatttacaggcatgagccacctcatctaacctatcatcttttaattcaagtggtttttgctttagattttgtaacttgggatataatcttcataccattccctgttgttaagtgtttcttccactctccgaaaatttttttgtatttttccttttttaactttatttttaggttatagattaaacatatcattgatggagaaagaaaaatatcaacttctgttttttgcagggggaggggttaaggttaaattatttctctttgacccatattccttatttaaaatcttaatagctatgatcttttcgtacctttggtaaactccctgaatcaatttctgctttgaaatattaaaaagaccttttgtattgttgagtctttaaactgtgcttttttttgcatctgctagtaatatgacagaatcatctgttatgttctaattttgagagcagacctattattcagacttgtttatggccttaaaatttaattttttctattaaaagataatatgatcaccaagtgacttttcaacagtataagctataggttgtggtgttctctgtcctgcttttttgatgctattcagattgaaaaaataaacattagtgccccttttttatagaaaaattaatggaactttatatatgaaaaatatttgggattttttcccccagaaagtgagtaaaaaatagtaagtttatgcttgtttagcaagctatttctaatgttgaaaagaaaggaaatagtctctaattaccccatctatcagtttaattagaaatgtgttaatgttttgtaaagaaaaatttgtgatttttatgcctaggtgatcaaaaatgtatgaccttataaatataatactcatgtaaaacacacatcccgcatgtttctctgactggtactagaacctagccaaatgattaattcatgagtactttctgttatgatctgtattatccaccatttgccattttctcttttcttgttggtgtttgttgtcataggtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggtgcagtaaatcctgcctaggaagcggctgtactgtgtttcctgtgaatggccttcatgtgcctgtgcttcgctcctctccccgccgcctgacagtgtgatttatggctgttgttttccaccagtccactgtttgccctctaggagggattggtctcttgagcctccataataacagcagccctttcacagacatcttctaatgacaacagcactgcattcagagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtca

SEQ ID NO: 131478 - DNA, 4243 bp, Homo sapiens
  Payload ID: 5657
  Gene Symbol: ERCC6L
  Gene Name: excision repair cross-complementation group 6-like
  Uniprot ID: Q2NKX8
  ENST ID: ENST00000334463
  CDS Start-End: 137-3889
ctctccacggcgcacagagcatgcgcggggcgggagtgagcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgtt

SEQ ID NO: 131479 - DNA, 4344 bp, Homo sapiens
  Payload ID: 5657
  Gene Symbol: ERCC6L
  Gene Name: excision repair cross-complementation group 6-like
  ENST ID: ENST00000373657
  CDS Start-End: 604-3987
atgcgcggggcgggagtgagcgaaattcaagctccaaactctaagctccaagctccaagctccaagctccaagctccaaactcccgccggggtaactggaacccaatccgagggtcatggaggcatcccgaaggtttccggaagccgaggccttgagcccagagcaggctgctcattacctaagggtcttgctgtgtcgcccagactggaattcagtggcctgatcatagttcactgcagcctcgaactcctgggctcaagcagtcctcctgccccagcctccctagtagctgggacttaagatatgtgaaagaggccaaagaagcaactaagaatggagacctggaagaagcatttaaacttttcaatttggcaaaggacatttttcccaatgaaaaagtgctgagcagaatccaaaaaatacaggaagccttggaggagttggcagaacagggagatgatgaatttacagatgtgtgcaactctggcttgctactttatcgagaactgcacaaccaactctttgagcaccagaaggaaggcatagctttcctctatagcctgtatagggatggaagaaaaggtggtatattggctgatgatatgggattagggaagactgttcaaatcattgctttcctttccggtatgtttgatgcatcacttgtgaatcatgtgctgctgatcatgccaaccaatcttattaacacatgggtaaaagaattcatcaagtggactccaggaatgagagtcaaaacctttcatggtcctagcaaggatgaacggaccagaaacctcaatcggattcagcaaaggaatggtgttattatcactacataccaaatgttaatcaataactggcagcaactttcaagctttaggggccaagagtttgtgtgggactatgtcatcctcgatgaagcacataaaataaaaacctcatctactaagtcagcaatatgtgctcgtgctattcctgcaagtaatcgcctcctcctcacaggaaccccaatccagaataatttacaagaactatggtccctatttgattttgcttgtcaagggtccctgctgggaacattaaaaacttttaagatggagtatgaaaatcctattactagagcaagagagaaggatgctaccccaggagaaaaagccttgggatttaaaatatctgaaaacttaatggcaatcataaaaccctattttctcaggaggactaaagaagacgtacagaagaaaaagtcaagcaacccagaggccagacttaatgaaaagaatccagatgttgatgccatttgtgaaatgccttccctttccaggaaaaatgatttaattatttggatacgacttgtgcctttacaagaagaaatatacaggaaatttgtgtctttagatcatatcaaggagttgctaatggagacgcgctcacctttggctgagctaggtgtcttaaagaagctgtgtgatcatcctaggctgctgtctgcacgggcttgttgtttgctaaatcttgggacattctctgctcaagatggaaatgagggggaagattccccagatgtggaccatattgatcaagtaactgatgacacattgatggaagaatctggaaaaatgatattcctaatggacctacttaagaggctgcgagatgagggacatcaaactctggtgttttctcaatcgaggcaaattctaaacatcattgaacgcctcttaaagaataggcactttaagacattgcgaatcgatgggacagttactcatcttttggaacgagaaaaaagaattaacttattccagcaaaataaagattactctgtttttctgcttaccactcaagtaggtggtgtcggtttaacattaactgcagcaactagagtggtcatttttgaccctagctggaatcctgcaactgatgctcaagctgtggatagagtttaccgaattggacaaaaagagaatgttgtggtttataggctaatcacttgtgggactgtagaggaaaaaatatacagaagacaggttttcaaggactcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatggtaaaggtacaggtagtgctgactctatagctactttaccaaaggggtttggaagtgtagaagaactttgtactaactcttcattgggaatggaaaaaagctttgcaactaaaaatgaagctgtacaaaaagagacattacaagaggggcctaagcaagaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccagagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaagtgttttc

SEQ ID NO: 131480 - DNA, 4564 bp, Homo sapiens
  Payload ID: 5658
  Gene Symbol: ERCC6L2
  Gene Name: excision repair cross-complementation group 6-like 2
  Uniprot ID: Q5T890
  ENST ID: ENST00000288985
  CDS Start-End: 306-2444
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaaggtatatattatttgaatcctataaatgttgttactattatacagtttctgatatatactgctgagtttctattttatagtaactatatttgattctgaattcagtggcccatttggagtcctactttttggggttttttccccttgctttttaaatacgctgtttctttcatgaatttgttctttccagtttcccttttcatatcaataactttgtttgccctccagctcccaaacccagctgctacctccatctcagagtactacttgacatgcctatattgatgttaaagtcaattgtctataaaaatattagcattttattatttatcctgttttctgtcatatatgacatagttacctgtttttatcagaataaccacctatttctttgttaaacaagtgttatataagacatatcaggatgacaggttattaagtagaaaaagttcccttgtttatcgtgccactgcactccagcctggggaacaaagcaagagacttgtctcaaaaacaaaaaacaaaaacaaaaaaaagttctcttgttcactggttattctaagaatatcttgtttcaccttcagaagtgtttattaatgacaggaccatccatgtcttacattttcttttttaaaaatatcttttaagttctttaatataccagaacactaagaatattaacctattttctaattgatattaataaggggtgacaaggccatccatgccctacatttgtcttgctaggcatatcattggcacttgattattaagttaaattttgaattaaaattactcatttgtcatcaatcagaatgtaaatttattcaggattggttagattcatgctgctttgggccaaaaggtgcttctaaatattattattagccccatataatgggagtacctatcataaagtaaaaggagtatttcacttcatgtgagacatttttaatttttaaaggttgtataaaatctcttttaaaatgttttaagatgtaaaaatttgaatatttacacttataatcttatgatttctgggcaatttcattctgttttgcattgactttccattatctatattatggtttctcttcaaagatagatattgagagttcattttacaagtatttgttgagcatctgctaaatgtcaggtactgttcatagagctttgcatacataaaagaacaaaataaacaaaacgatcctgtcta

SEQ ID NO: 131481 - DNA, 2936 bp, Homo sapiens
  Payload ID: 5658
  Gene Symbol: ERCC6L2
  Gene Name: excision repair cross-complementation group 6-like 2
  ENST ID: ENST00000320486
  CDS Start-End: 1-1568
caaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcagaaaacaatttgaagaaatggcctcttattttaactcgtcttctgtaaacgaatttgctaaacatataaccaatgccacatcagaagaacgacagaaaatgctaagagacttttatgcttctcaatatccagaggtaaaagaattttttgtggattctgtgtcacaattcaacaattcttcctttgagaaaggagagcagcgcacccggaagaaatctgataaaagagaatctcttataaaaccaaggctgtcagattctgaaaccttgtcatttaaagattctaccaacaaaatttctcaagtttgcagcctaaaaacatataaaagaaaatcagttaagtttcagaatcatatttcctatagagaagaggtgttttttaatgatgcagaaactaagaaatcacctgttagttctactcaagagattgacagtgggaaaaacagccaggcatccgaagatactgtgacatcccgttctctgaacagtgagtctgaaacacgtgagagaaggttagaaaataccatgaaagaccaacaggacctcacaagaacgggcatttcaagaaaagaaccccttctcaaattggaaaacaaaaagatagaaaatccagtgctggaaaatacttctgtgataagcttacttggtgatacctctattcttgatgacctttttaaaagtcatgggaacagtcccacacaactgccaaagaaagttctttcagggcccatggaaaaagcaaaacagagaccaaaagatttctgggacatcttgaatgagcagaatgatgagagtcttagtaaactcacagacttggcagtaatagagactctgtgtgaaaaagcacctctagcagcaccctttaaaaggagagaagagccagcaacttctctttggaaatcaaatgagaaatttttatggaagaaatttagcccaagtgatacagatgaaaacgcaaccaatacacagagtaccacataagcatataaatgaattactgcaccagtaaactgctgccatcactgtttacggcactggattccacactgattctattatcttgaacacagttgttgacatatatttttattaaattattgctttaggattttttgaagtctaaagtattgtcatggatctgtttttcttgatatttgatttgatctttcaagaatatgattgtatttatagtataaacctctgttatgaattagaaaagattctaggtttgttaataggagacctgggacatctttcttactatattacataatgatgtgacacttgccccggtgagcattgtttcccagtatgaaagatgaagagtctgtaccgaatcagcatgagtgtccttccagtttaaaaaagctttgcttcgctctcctaatggctcataggctgaatcatgtctgcccctcaaatcaggtgtataccaatgtgttttttactagcacttgggaaagttattaagtattttctttttccctgggcatcatgttctattattattttagaaaaaagtcataattggtactgaatatatggtatatataatattaaaatggtaattttgcaacagctcaaaattaaaaggttaatgttatacactttactatatgagctgtgattactaccattagccacagataccagtgcctcaactttttatgtacctattgtgatttaatgtaaataaaggtttgtatagtacttttgtagttcttaagtatgaagaaatgggtaaactttttattttgttagaaactgttatattttgagtgtaatatttatggtttatagcaaaatgaatgtgcttattgttgaatgcatgtatttagaagcctttactcagcccctgtgttctgtgctaggagcttgagctctacaggtaaggcagagctaccggtgaatgaaaggaaatcatgtcagtgaaaaatcatggtggaaagcccctggcatcacatgtgcatgctgtaggcaggacctgagctgcctccgctgcaggttcagatgcaccgctgcagctgtccttcagttagttcacagggctgcaagaggaggacacatccctccagaaaacagcctgagccgggaactggctgtgctaaagagcactgctatcaagttgaggagagagggcttccgtgtactcaggatgtagagtcattgctcagaagtgaacaaaaaatcaaaaacaaaagtcttctcaagggactgatcggccaagtatgcttttctttagagcaatgttttgccctagagaattgtaaaatttatgtcatgactcagtacatatgtgttcgtacatatatgattggaataaaatgtttatgaaatatttactcataa

SEQ ID NO: 131482 - DNA, 546 bp, Homo sapiens
  Payload ID: 5658
  Gene Symbol: ERCC6L2
  Gene Name: excision repair cross-complementation group 6-like 2
  ENST ID: ENST00000402838
  CDS Start-End: 1-546
ttgggatccataacctcttcaaatttaggtcccaagggtcttgtcttacgaaggacatcctggagagagaaggccaagtagaagcagggatcatgacagccacaacatggttgaaagagggacctccagcacacaaactggaaatgcctagacagcctgactgtcaggaatgcagaggtacagaacaagctgcagagccactggcaaaggaagcatgtgatctctgcagtgacttcagtgatgaagagccagtgggagccacaggaataaagactgccaaaaacaaagcacccgattcaagtaaagcttccagctctccaggacagcttaccttactccagtgtggtttctcgaaattgcttgaaacaaaatgtaaagcagttgaggatagtgatggaaatactgcctctgatgatgaaagttctgatgagcagcccacatgcctttcaacagaagccaaagatgctggttgtgagaaaaatcaggactctcttggtacttcaaaacatcagaaattagataacatcctaaatccaaaagaaaagc

SEQ ID NO: 131483 - DNA, 498 bp, Homo sapiens
  Payload ID: 5658
  Gene Symbol: ERCC6L2
  Gene Name: excision repair cross-complementation group 6-like 2
  ENST ID: ENST00000426805
  CDS Start-End: 1-249
gaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatgtaagaaaattaaatttaataactagatttttatccaattgtttttgagatttagcataatttttaaaactattactggattaatttttaatggctatgcttatttagaagcagcaaaaatactattatgaccgaaatttcaatgtcttaagttttagctaagcttttctctcatttcctttatcaacattgaattcctcttagaagtctgggtttataaaggtaacaataaaaaaattgatacttcctccta

SEQ ID NO: 131484 - DNA, 1822 bp, Homo sapiens
  Payload ID: 5658
  Gene Symbol: ERCC6L2
  Gene Name: excision repair cross-complementation group 6-like 2
  ENST ID: ENST00000456993
  CDS Start-End: 1-1098
atgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagta

SEQ ID NO: 131485 - DNA, 2849 bp, Homo sapiens
  Payload ID: 5658
  Gene Symbol: ERCC6L2
  Gene Name: excision repair cross-complementation group 6-like 2
  ENST ID: ENST00000479391
  CDS Start-End: 1-164
gtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtgagttcatctaaagtatatccttgattggccagcctcaacttttgaggcataaagaataaagcatatgcctacatgacaccttacagccacattttctcttatctacacagtaggaaatagtgagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaagagagaaggccaagtagaagcagggatcatgacagccacaacatggttgaaagagggacctccagcacacaaactggaaatgcctagacagcctgactgtcaggaatgcagaggtacagaacaagctgcagagccactggcaaaggaagcatgtgatctctgcagtgacttcagtgatgaagagccagtgggagccacaggaataaagactgccaaaaacaaagcacccgattcaagtaaagcttccagctctccaggacagcttaccttactccagtgtggtttctcgaaattgcttgaaacaaaatgtaaagcagttgaggatagtgatggaaatactgcctctgatgatgaaagttctgatgagcagcccacatgcctttcaacagaagccaaagatgctggttgtgagaaaaatcaggactctcttggtacttcaaaacatcagaaattagataacatcctaaatccaaaagaaaagcatattttttataaaagtgagaagattttagaacagaatatttcttccaagtctgacgagaaaaaaattaaaaatacagataaacattgcattttacagaatgtcacagaatcagaagatagtgatgtcatctgtcctacacaatacacaactgagagattccccgacaatagtataaggtttaagccacccttggaaggatctgaggattctgaaacagaacacactgtaaaaacaagaaataatgataatagtcgaaacactgatgacaaaagaaatggaataatttcaaaaaagttaagtcctgagaacacaaccctgaaatctattttgaaaagaaaaggcaccagtgatatcagtgatgaatctgatgacattgaaatttcttccaagtcaagagtaagaaagagagctagttcattgaggtttaagagaataaaagaaaccaaaaaagaacttcacaattctcccaaaacaatgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtatattgtctctgacaatactatacttgaagaataattctcaaaggaaatgtagctcattagtaaaatatgtaaatacttgaattataaccataactgacatctgaatatttcagaaaaatctgaatttcaaaaataaactgcaaatgtttta

SEQ ID NO: 131486 - DNA, 2017 bp, Homo sapiens
  Payload ID: 5659
  Gene Symbol: ERCC8
  Gene Name: excision repair cross-complementation group 8
  Uniprot ID: Q13216
  ENST ID: ENST00000265038
  CDS Start-End: 44-1234
gtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtctc

SEQ ID NO: 131487 - DNA, 2236 bp, Homo sapiens
  Payload ID: 5659
  Gene Symbol: ERCC8
  Gene Name: excision repair cross-complementation group 8
  ENST ID: ENST00000381118
  CDS Start-End: 44-217
gtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagataaaatgaagcttcttatccaagatgctcaaggaaataaaatgtgagtcaaggattttatatccagccaaactgatttcagatacaaaaaggacggataaattgtcaacaacacaagaattcagagactgttgttctcattagccattccttaggaatcaaccagagaatgaaatcattcaaccagaatgacaagagagacagcaacttaaggattgacgcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtctcc

SEQ ID NO: 131488 - DNA, 684 bp, Homo sapiens
  Payload ID: 5659
  Gene Symbol: ERCC8
  Gene Name: excision repair cross-complementation group 8
  ENST ID: ENST00000439176
  CDS Start-End: 282-684
tccagtcccgcccctgagctctgtcatggcgacgtccagtgctccagccggtgtgaggacacgatatgctggggtttttgtccgcacgccaaacgggtttggaggaccctcttcgccttcggagagcagagtcaacacggagttcacagacaattcagtcctgaagtcattatgttgggcagagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagttt

SEQ ID NO: 131489 - DNA, 3357 bp, Homo sapiens
  Payload ID: 5660
  Gene Symbol: EXOC1
  Gene Name: exocyst complex component 1
  Uniprot ID: Q9NV70
  ENST ID: ENST00000346134
  CDS Start-End: 134-2818
agtgttgggggaacggccgcttcccgttcaacgctttattgaggggcgtatcctagtggcccccatccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttt

SEQ ID NO: 131490 - DNA, 3248 bp, Homo sapiens
  Payload ID: 5660
  Gene Symbol: EXOC1
  Gene Name: exocyst complex component 1
  Uniprot ID: Q9NV70
  ENST ID: ENST00000349598
  CDS Start-End: 70-2709
atccggtctccgttttggaagacccgcctcggcacagccaggctcagtccggccttgcgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaagttgacatttgataatatttt

SEQ ID NO: 131491 - DNA, 3551 bp, Homo sapiens
  Payload ID: 5660
  Gene Symbol: EXOC1
  Gene Name: exocyst complex component 1
  Uniprot ID: Q9NV70
  ENST ID: ENST00000381295
  CDS Start-End: 349-3033
cttccttctctacgcggtcaacttccggcgcggagtttgtcacgtgcccggatataggaagtgttgggggaacggccgcttcccgttcaacgctttattgaggggcgtatcctagtggcccccatccggtctccgttttggaagacccgcctcggcacagccaggctcagtccggccttgcggtaagccttcggccgcggctgcccggtagtcccggcggcggcggacagacgagctgacaggcaccagggtctaaggcggctcctcagtccggctgctgtctccacgcctggggtcgggcaccgctccttctgaccttcctttccccgtttgtcccgctgagaaaagatgacagcaatcaagcatgcattacaaagagacatttttacaccaaatgatgaacgcctgctgagcattgtgaatgtctgcaaagcaggaaaaaagaaaaagaactgttttttatgtgccacagtgacaactgaacgccctgtgcaggttaaggtggtcaaagtcaagaaatccgataagggagatttctacaaaaggcagattgcatgggcccttcgagatcttgctgtggtagatgccaaagatgctatcaaagaaaatcctgaatttgatttacactttgaaaaaatatataaatgggttgccagcagcactgctgaaaagaatgcatttatttcatgcatttggaaattgaatcagcgatatctccggaagaaaattgattttgtcaatgttagctcacagcttttggaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtgaaccacatggacttggccaaaggtcatataaaggcccttcaggaaggagatcttgcttcttccagaggcattgaggcctgcaccaatgctgctgatgcccttctgcagtgcatgaatgtagctcttcgaccaggccatgacttgcttctggcagtcaaacagcaacagcagcgattcagtgatttgcgagagctttttgcccggagactggccagtcacctcaacaatgtttttgttcaacagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaagaattacatggattatttatcccgactatatgaaagagaaatcaaagatttctttgaagttgcaaagatcaagatgactggcacaactaaagaaagcaagaagtttgctacactgcctcgaaaagaaagtgctgtcaaacaggaaacagagagtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataagatctttgaacaggtactaagtgaactggagcccctatgtctggcagaacaggacttcataagtaaatttttcaaactacagcaacatcaaagtatgcctggaactatggctgaagcagaggacctggatggaggaacattatcacggcaacataattgtggcacaccactgcctgtttcatctgagaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatgtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaatgaagcatttgagtataacagacactataccaaaataccaagcaactgttttgagaacccagacttaaaattttatgtattattaaatgttagataaatgggtagtaccatactacaaatatttaaatgcaaaattaccaacctatatagcagttttatttgccctataggttgcatactaacttaagcattcatgtcaccataaaatgcctttagcatttctcaatgactggatgggaaattttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgaggattatgtgactagtaataaatgtgaaataaattttcaaaaaa

SEQ ID NO: 131492 - DNA, 4449 bp, Homo sapiens
  Payload ID: 5661
  Gene Symbol: EXOC2
  Gene Name: exocyst complex component 2
  Uniprot ID: Q96KP1
  ENST ID: ENST00000230449
  CDS Start-End: 137-2911
gtgaggtgccggcggctggcggccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaaccctcatttcatataaatggccttaagttttctaattcaagcgggtttttggaaaaatttatggtctccattaaaatacatattacaactggggtagattatttgtggtccaggtgtctgtgatttaactttgcgttttgctatctgatttttatttttcacagggctaagcatgagctttcattctcactcactcttaatttgtcgtgcgtcactacacatgcacgtgttgcagtccctgaggccctgtgtgttatctgtgatggagtgtgaatgtgtaacgggcactgtgttacactctgaggtgttggcggggcggtcgcagacttcagggtcccctaacggaaaggccaggctccgcgtggacggccaactccctgcccgctccttcagcaggtgactgtctctgccacttcttacctgctgaaggatcttgctcagtagctggaacaatgctgctgtcacacagtctcttctctgaaacttcaggatgctccttggtcaccaggcaatgggagctgtagaccagccgcatgcacttgccccacattcactgctgactggcttcactggaataggttcaggtcaccgggacttctctcagagtcagcggcccacccaactccctcataccgtcgcatctgaaaattttcagagaggaattctctttgtagtcggcttgtcagggttttcaagtttttctatggttatttttaaatctctttttttaaatgctaaaattaatgtcctcattaatgcaagtaattttagagcacagtgtagccatgtacagtttccattatttaaaataaataaatgtgttggttcatttggtgtatggggggacatcatggtaactggaaatgaaagtttaatctttcacaaatgtgcttgataaagctgttaagaattgtctttcctaagtatgttaactgttgtatctaactcaactgtgagctaagtttaaaaactgcaatcatgaatgtttgtgatattttaaatatctactacagcacattcagccaataaagaatctgcctttaatgtaagttgtaatttacttga

SEQ ID NO: 131493 - DNA, 720 bp, Homo sapiens
  Payload ID: 5661
  Gene Symbol: EXOC2
  Gene Name: exocyst complex component 2
  ENST ID: ENST00000443083
  CDS Start-End: 299-720
gtgaggtgccggcggctggcggccgcggagtcttcggcgagacctaccgggccctgtctgtgccggccgtgagctgcggcaggacggctggagtaaatcttggtgccaataatggaacgaacactggacacaggactggggaagactggatttcagcttaggagaagaatactaagaagtttcagcagtggaatgcctactcttcttataaccggagtggaaacggaagcattttgtgagagggctggagggaagattacttctctaacaggatcaccagtttgctccacaaagcacaatgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaa

SEQ ID NO: 131494 - DNA, 2682 bp, Homo sapiens
  Payload ID: 5662
  Gene Symbol: EXOC3
  Gene Name: exocyst complex component 3
  Uniprot ID: O60645
  ENST ID: ENST00000315013
  CDS Start-End: 58-2295
gtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcag

SEQ ID NO: 131495 - DNA, 424 bp, Homo sapiens
  Payload ID: 5662
  Gene Symbol: EXOC3
  Gene Name: exocyst complex component 3
  ENST ID: ENST00000508022
  CDS Start-End: 219-424
cggcggcggcgtagccgtagaggattttctacgttggtatgccaaatttcataatcagaaaataaagagaaaggaaaggttgcaatgtaggtccagatgaaaaaggagaagagaggtgtctgaaagcatgtgggcatggagaatgaaaaattccaggagaagtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccct

SEQ ID NO: 131496 - DNA, 5365 bp, Homo sapiens
  Payload ID: 5662
  Gene Symbol: EXOC3
  Gene Name: exocyst complex component 3
  ENST ID: ENST00000503889
  CDS Start-End: 1-1421
acctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaaggtaagaaggtgggacctagttccctcatcaccttgacgctagggctcacctctcaccctgctcagaattcagcatccagcgagtccctccgtgagtgaacgttcacttgttgtcctatcagcccaagggaggcaataggctctgcggacgccacctccctgggacggggctctggtgagaatggccggggccctgtggcatggccctcgaggtggagggagccatggttcccggagaggcccgcgtgccccgtcttagctccttgccttccactcactccctgaggccccagggatttctttccgcttcagaccctccttcctgcaggacccaggttcctctttcctccaaagtgcctgccgcgttttccagatgctgcggtcgttatcaaaggacagcagcagccactgacacgggcctgtctgtggaccgagtgctcatgcgcggcactgcctcgcccgcgtctgtcctgctgggggccggagctggcctggtgcgggggtccaggtcaccgtcactgttcccccactgagcccccgctcctcctctgcggtgagatgccagagccgtggcggagcgaggaggagtgggctcagagcctccggggagccaccgggagccccagcctgggtttcaatgagggtgctcctggccgccagagccgtggagcctgccgctgaccgcgcgtgtctccccagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaatgaaaacgccatgcattctcttttccagttaaggttttctgactactgatctaggattgcccaggaactgttgtcaatcacagagtaaaagtctccgctcagcctggagggcgccctcctggtcccctcctgtctgacatcccctcagcctagagggcgccctcctggtcccctcctgtctgacatcccctcagcctagagggtgccttcctgatcccctcatgtctgacatcccctcagcctggagggcgccctcctggtcccctcctgtctgacatcccctcagcctggatggcgccctcctggtcccctcctgtctgacatcccctcagcctagagggcgccctcctggtcccctcctgtctgacatcccctcagcctggatggcgccctcctggtcccctcctgtctgacatcccctcagcctagagggtgccctcctgatcccctcatgtctgacatcccctcagcctggatggcgccctcctggtcccctcctgtctgacatcccctcagcctagagggtgccctcctggtcccctcatgtctgacatcccctcagcctagagggcgccctcctgatcccctcatgtctgacatcccctcagcctggagggcgccctcctggtcccctcgtatctgacatcccctcagcctggagggcgccctcctggtcccctcctgtctgacatcccctcagcctggagggcgccctcctgatcccctcctgtctgacatcccctcagcctggagggcgccctcctggtcccctcgtatctgacatcccctcagcctggagggcgccctcctggtcccctcctgtctgacatcccctcagcctggagggcgccctcctgatcccctcctgtctgacatcccctcagcctggagggcgccctcctggtcccctcgtatctgacatcccctcagcctggagggcgccctcctggtcccctcgtatctgacatcccctcagcctggagggcgccctcctggtcccctcgtatctgacatcccctcagcctggagggcgccctcctggtcccctcctgtctgacatcccctcagcctggagggcgccctcctggtcccctcctgtctgacatcccctcagcctggagggcgccctcctggtcccctcctgtctgacatcccctcagcctggagggcgccctcctggtcccctcctgtctgacatcccctcagcctggagggtgccctcctggtcccctcctgtttgacatccccagagttactccttgggtcctttgagagatgagacaccagctgcacccagcaagccctgtccccacccccagctaatcaaggcattaccccggaggccgggcgcagtggctcacgcctgtaatcccaacactttgggaggccaagatgtgaaaaattcacaaatgggacttcttgaaagaatcaaaacttgagaagtaactgagaagtagaagcagctcttaacaagcatcaggggctcagaagaggtagctcttcccagggcatccagcgggcgagctgttccatgtgcctctgaacccagcttcccacttagcagcaggtcttgagtgcacctggcatacacctgtgcaattctcgtcaacacagaacacctgcctgcccacccccggtgctgaagaccgaccagtcaaggaggtgttggtgggagtgttgtgttcaccatgtggagatcaggcggcgattaccgcatcttctttgctgactttggtaaccgggtgtccagggaggagcgatcgggagtggccaagcagttgcctggactcagcttctgactctgcagctgggagtcagatgcaggcccaagggtccaggggagttgttcagcgcctggaatcgccatgcattgcgcggtggaccgcacgacgctcctgctctgttctcccaggcacagacaggcacttggaaggcagctttgctcctctggccacccggaaacctcccagcagttcagatgggacaaactgggggcctgtcagaacagccacttgtgccgggaaggccaggccccggcctgctccgatgaacgtcaggacggtggctgcagcagggaaccagggctggccttggatctgtccagtagggtcactgactgggcagggcttgctgcatagaggatggctgcattttgtgctcagagttggttgaaatggctacgaagtgtggagaataaccactgaatcccaaaaagtcactgcgcttgatctgatccaagtaacagtgactgcagttagggtcgagagcttctccgaagcagcggtcatgcaggcttttgtgtggctgacgcttccctttttcacaacagtaaaaagctatcaatgggaaattgtggacttttcccaccagggactcaatggggactcaatgtgcaatattcagtcaacataaaactctttaagaactc

SEQ ID NO: 131497 - DNA, 5748 bp, Homo sapiens
  Payload ID: 5662
  Gene Symbol: EXOC3
  Gene Name: exocyst complex component 3
  ENST ID: ENST00000515601
  CDS Start-End: 115-1503
ggcggcggcggcggcggcggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggaggtgggcctggctctttcctcctgccgttttctgggccgaagcccagtgcttcctcactgccctctgggacacaggctgtgaactgtaccgtgcggatgccgtctggggagccgggctgtgcacttgcattccggtcagatcgcttaaagcgcctccgttttcggtgacgctgcttcgtatgatgcagggtccttcttacgcacaattcagtagattcaccctcaacatctgaatgaattgatgacgaagaagtggctattagggtcaaacgctgtagacattatctgtgtcaccgtggaagactatttcaacgattttgccaaaattaaaaagccgtataagaaggtaagaaggtgggacctagttccctcatcaccttgacgctagggctcacctctcaccctgctcagaattcagcatccagcgagtccctccgtgagtgaacgttcacttgttgtcctatcagcccaagggaggcaataggctctgcggacgccacctccctgggacggggctctggtgagaatggccggggccctgtggcatggccctcgaggtggagggagccatggttcccggagaggcccgcgtgccccgtcttagctccttgccttccactcactccctgaggccccagggatttctttccgcttcagaccctccttcctgcaggacccaggttcctctttcctccaaagtgcctgccgcgttttccagatgctgcggtcgttatcaaaggacagcagcagccactgacacgggcctgtctgtggaccgagtgctcatgcgcggcactgcctcgcccgcgtctgtcctgctgggggccggagctggcctggtgcgggggtccaggtcaccgtcactgttcccccactgagcccccgctcctcctctgcggtgagatgccagagccgtggcggagcgaggaggagtgggctcagagcctccggggagccaccgggagccccagcctgggtttcaatgagggtgctcctggccgccagagccgtggagcctgccgctgaccgcgcgtgtctccccagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaatgaaaacgccatgcattctcttttccagttaaggttttctgactactgatctaggattgcccaggaactgttgtcaatcacagagtaaaagtctccgctcagcctggagggcgccctcctggtcccctcctgtctgacatcccctcagcctagagggcgccctcctggtcccctcctgtctgacatcccctcagcctagagggtgccttcctgatcccctcatgtctgacatcccctcagcctggagggcgccctcctggtcccctcctgtctgacatcccctcagcctggatggcgccctcctggtcccctcctgtctgacatcccctcagcctagagggcgccctcctggtcccctcctgtctgacatcccctcagcctggatggcgccctcctggtcccctcctgtctgacatcccctcagcctagagggtgccctcctgatcccctcatgtctgacatcccctcagcctggatggcgccctcctggtcccctcctgtctgacatcccctcagcctagagggtgccctcctggtcccctcatgtctgacatcccctcagcctagagggcgccctcctgatcccctcatgtctgacatcccctcagcctggagggcgccctcctggtcccctcgtatctgacatcccctcagcctggagggcgccctcctggtcccctcctgtctgacatcccctcagcctggagggcgccctcctgatcccctcctgtctgacatcccctcagcctggagggcgccctcctggtcccctcgtatctgacatcccctcagcctggagggcgccctcctggtcccctcctgtctgacatcccctcagcctggagggcgccctcctgatcccctcctgtctgacatcccctcagcctggagggcgccctcctggtcccctcgtatctgacatcccctcagcctggagggcgccctcctggtcccctcgtatctgacatcccctcagcctggagggcgccctcctggtcccctcgtatctgacatcccctcagcctggagggcgccctcctggtcccctcctgtctgacatcccctcagcctggagggcgccctcctggtcccctcctgtctgacatcccctcagcctggagggcgccctcctggtcccctcctgtctgacatcccctcagcctggagggcgccctcctggtcccctcctgtctgacatcccctcagcctggagggtgccctcctggtcccctcctgtttgacatccccagagttactccttgggtcctttgagagatgagacaccagctgcacccagcaagccctgtccccacccccagctaatcaaggcattaccccggaggccgggcgcagtggctcacgcctgtaatcccaacactttgggaggccaagatgtgaaaaattcacaaatgggacttcttgaaagaatcaaaacttgagaagtaactgagaagtagaagcagctcttaacaagcatcaggggctcagaagaggtagctcttcccagggcatccagcgggcgagctgttccatgtgcctctgaacccagcttcccacttagcagcaggtcttgagtgcacctggcatacacctgtgcaattctcgtcaacacagaacacctgcctgcccacccccggtgctgaagaccgaccagtcaaggaggtgttggtgggagtgttgtgttcaccatgtggagatcaggcggcgattaccgcatcttctttgctgactttggtaaccgggtgtccagggaggagcgatcgggagtggccaagcagttgcctggactcagcttctgactctgcagctgggagtcagatgcaggcccaagggtccaggggagttgttcagcgcctggaatcgccatgcattgcgcggtggaccgcacgacgctcctgctctgttctcccaggcacagacaggcacttggaaggcagctttgctcctctggccacccggaaacctcccagcagttcagatgggacaaactgggggcctgtcagaacagccacttgtgccgggaaggccaggccccggcctgctccgatgaacgtcaggacggtggctgcagcagggaaccagggctggccttggatctgtccagtagggtcactgactgggcagggcttgctgcatagaggatggctgcattttgtgctcagagttggttgaaatggctacgaagtgtggagaataaccactgaatcccaaaaagtcactgcgcttgatctgatccaagtaacagtgactgcagttagggtcgagagcttctccgaagcagcggtcatgcaggcttttgtgtggctgacgcttccctttttcacaacagtaaaaagctatcaatgggaaattgtggacttttcccaccagggactcaatggggactcaatgtgcaatattcagtcaacataaaactctttaagaactcc

SEQ ID NO: 131498 - DNA, 2825 bp, Homo sapiens
  Payload ID: 5662
  Gene Symbol: EXOC3
  Gene Name: exocyst complex component 3
  Uniprot ID: O60645
  ENST ID: ENST00000512944
  CDS Start-End: 190-2427
agtgcccgcgcgctgtccacttccggccgggaccccggaggcggaggcagcgaaggcggagggggcggcgggggcggcggcggcggcggcggcggcggcggcggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaatgaaaa

SEQ ID NO: 131499 - DNA, 2510 bp, Homo sapiens
  Payload ID: 5663
  Gene Symbol: EXOC3L1
  Gene Name: exocyst complex component 3-like 1
  Uniprot ID: Q86VI1
  ENST ID: ENST00000314586
  CDS Start-End: 242-2482
ctttctgttgatggccttggggagggaggagcctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctgcagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttgggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgt

SEQ ID NO: 131500 - DNA, 2247 bp, Homo sapiens
  Payload ID: 5663
  Gene Symbol: EXOC3L1
  Gene Name: exocyst complex component 3-like 1
  ENST ID: ENST00000545725
  CDS Start-End: 210-2247
ctcggtgggaagaaggggcttctgggtggggagtgggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactgtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagagggctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccgga

SEQ ID NO: 131501 - DNA, 2225 bp, Homo sapiens
  Payload ID: 5663
  Gene Symbol: EXOC3L1
  Gene Name: exocyst complex component 3-like 1
  ENST ID: ENST00000563889
  CDS Start-End: 174-2225
gagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggctcttccttcccaggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactgtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagagggctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccgg

SEQ ID NO: 131502 - DNA, 1845 bp, Homo sapiens
  Payload ID: 5663
  Gene Symbol: EXOC3L1
  Gene Name: exocyst complex component 3-like 1
  ENST ID: ENST00000564324
  CDS Start-End: 424-666
gctggagtcagctggagttgcccaggccctgtgagcaagtggcaggcgtgcccagctgcattggggagagggctgttctcaaggccaaggtcatttttggagggagaactggacgcctgatcaaatctggtaagttctgtaccaaactgtcctgtgcagctcagagcaggaccagggtccagtggaggcctgtgcccactctgtctcgcttgacatctgcaggggcacgactgggaaacctagcaggcaaagcctcccaggtgccctccgcatcacacccgctccctctcacttcccgagggggccgggaagaacctccttcctcctctcagaagggcttagacagaggcagcagctcacaggggcatctactctgcctgcttgccccgggcccacctcagctctggctcctccaggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaaggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctgcagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttgggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccgg

SEQ ID NO: 131503 - DNA, 803 bp, Homo sapiens
  Payload ID: 5663
  Gene Symbol: EXOC3L1
  Gene Name: exocyst complex component 3-like 1
  ENST ID: ENST00000564418
  CDS Start-End: 260-803
gggagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctgaagggcttagacagaggcagcagctcacaggggcatctactctgcctgcttgccccgggcccacctcagctctggctcctccaggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggg

SEQ ID NO: 131504 - DNA, 1706 bp, Homo sapiens
  Payload ID: 5664
  Gene Symbol: EXOC3L2
  Gene Name: exocyst complex component 3-like 2
  Uniprot ID: Q2M3D2
  ENST ID: ENST00000252482
  CDS Start-End: 29-1258
ccccagagaggtcctagggctggtggacatggccgccctggagaatggggagctggggccccttctctcccctggcaccctgcggggtttggaggatgaatgcgtcacagatgttaaggctcagacccgggctgcccttctccgtgtgctgcaggaggacgaagagcactgggggagcctggaggaccagcccagcagcctggcccaggatgtgtgtgagctgctggaagagcacacagagcgagcaccccgcatcagccaggagtttggggagcggatggcccactgctgcctaggcgggctggcagagttcctgcagagcttccagcagcgtgtggagcgattccatgagaacccagcagtccgggagatgctacctgacacctatatcagcaagaccatcgccctggtcaactgcggccccccactgagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctggagtcccaggcctcgtggctggatgccgtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttttcacccaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaaaaataaaaaattagctgggcacggtggtgtgtgcctgtagtcccagctactggtgaggctgaggctggaggatcactggagttcgaggctgcagtgagctatgactgtgccactgcactccagcctggtcaacaaagcaagaccctttctc

SEQ ID NO: 131505 - DNA, 1719 bp, Homo sapiens
  Payload ID: 5664
  Gene Symbol: EXOC3L2
  Gene Name: exocyst complex component 3-like 2
  Uniprot ID: Q2M3D2
  ENST ID: ENST00000413988
  CDS Start-End: 42-1271
acaatcaggtctaccccagagaggtcctagggctggtggacatggccgccctggagaatggggagctggggccccttctctcccctggcaccctgcggggtttggaggatgaatgcgtcacagatgttaaggctcagacccgggctgcccttctccgtgtgctgcaggaggacgaagagcactgggggagcctggaggaccagcccagcagcctggcccaggatgtgtgtgagctgctggaagagcacacagagcgagcaccccgcatcagccaggagtttggggagcggatggcccactgctgcctaggcgggctggcagagttcctgcagagcttccagcagcgtgtggagcgattccatgagaacccagcagtccgggagatgctacctgacacctatatcagcaagaccatcgccctggtcaactgcggccccccactgagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctggagtcccaggcctcgtggctggatgccgtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttttcacccaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaaaaataaaaaattagctgggcacggtggtgtgtgcctgtagtcccagctactggtgaggctgaggctggaggatcactggagttcgaggctgcagtgagctatgactgtgccactgcactccagcctggtcaacaaagcaagaccctttctc

SEQ ID NO: 131506 - DNA, 2293 bp, Homo sapiens
  Payload ID: 5665
  Gene Symbol: EXOC3L4
  Gene Name: exocyst complex component 3-like 4
  Uniprot ID: Q17RC7
  ENST ID: ENST00000380069
  CDS Start-End: 77-2245
cccacagggccacaacaggtttctgcatctgctcctatggccactccttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccagcaggcatccactggggcagcgtctgaggaactgaaacccgaggcagaaggcaaatccgtggccgacctcattactgaacggcaactgctggcggccttcgaacagcttctgcgcctggagacgctgctggtggccgagaaggcctcgcgcacctttgagcaggaccctacggccttcgcgcggcgcgctatggacgtgtgcctgctttacgacgggctggcagccgagatcggcgccatcgtgcgcgagacgctggacagcgacggtgtggacgcggccgcgctggccgagctggcccgcgtggtgagcgcggaggaggaagcccacccttctccccccgacgacggcgacttcctgcgcacgccgcgccgctggcgccagcactgggaggaggcggtgcggcgaagcgctcaggagcgcgtgcggcggccgggcgcggggtgggccttcggggaggcggagggcgcgtcgggtttggcccagcttctggccgagctgggtggcttggttcgccgcgacctgcagaaggtgcggcaggaggtgcagcccgcgtatgcggcggccggcttcccagcgtgggaggtctatctgcgtgccttccacagcgccgtggcccagcgcctccaggagctcgcgcgcgacgcccgcggctgcgagcagctctatatcctgctggactgggccgccaacgtctacggcagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgccgaggtccccgaggtgctgcagggcctctaccaggcgccgctgtccatggacgtccatatgctcgtggccgagcacgtgaaggcggccggcgccatctccgcggagctggaggccaccaccctgcgaatctgcacgcgggcgctcggcctcttcgtgcccaggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacactcaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtc

SEQ ID NO: 131507 - DNA, 657 bp, Homo sapiens
  Payload ID: 5665
  Gene Symbol: EXOC3L4
  Gene Name: exocyst complex component 3-like 4
  ENST ID: ENST00000560304
  CDS Start-End: 1-637
ccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacactcaagacctgctgagagctgcggccggggcggcgggtgcggaggcccctcggggccgcgtgctcttcgaggagatcaagccaagcgcagctgtcaggccagaaggagcagccgtgcaggaggcatttcaggcatcgttgaggggagtgttttggggccgcagagctctcaatgctgcctatcgggcgggggggggcctcccgcccgactgtccagcttcaccctccagtctgaaagtgaagagcagagtatttatttaaaaaataaatgtgaattaaaa

SEQ ID NO: 131508 - DNA, 460 bp, Homo sapiens
  Payload ID: 5665
  Gene Symbol: EXOC3L4
  Gene Name: exocyst complex component 3-like 4
  ENST ID: ENST00000559116
  CDS Start-End: 1-460
gagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccagcaggcatccactggggcagcgtctgaggaactgaaacccgaggcagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgc

SEQ ID NO: 131509 - DNA, 665 bp, Homo sapiens
  Payload ID: 5665
  Gene Symbol: EXOC3L4
  Gene Name: exocyst complex component 3-like 4
  ENST ID: ENST00000559661
  CDS Start-End: 1-46
gggcctctaccaggcgccgctgtccatggacgtccatatggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgc

SEQ ID NO: 131510 - DNA, 4185 bp, Homo sapiens
  Payload ID: 5666
  Gene Symbol: EXOC4
  Gene Name: exocyst complex component 4
  Uniprot ID: Q96A65
  ENST ID: ENST00000253861
  CDS Start-End: 30-2954
ggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggggtcctgatgacaacttaattgaaggtggaggaacaaaatttgtctgcaaacctggagccagaaacattaccgtcatattccacccattactaagatttattcaggagattgagcatgctctgggtcttggcccagccaaacagtgtcctcttcgagagtttctcaccgtgtacatcaaaaacatctttctcaatcaagtcttggctgagatcaacaaggagattgaaggagtcactaaaacatctgaccctttgaagattctggccaacgcagacaccatgaaggtgctgggagtgcagcggcctctcctacagagcacaatcattgtggagaagacagttcaagacctcctgaacctgatgcatgacttgagtgcatattcagatcaattcctcaacatggtgtgcgtgaagctccaggagtacaaggacacctgcactgcagcttacaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgaccgctgcttgcttgtcttacatctggaagtgagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagctta

SEQ ID NO: 131511 - DNA, 1604 bp, Homo sapiens
  Payload ID: 5666
  Gene Symbol: EXOC4
  Gene Name: exocyst complex component 4
  Uniprot ID: Q96A65
  ENST ID: ENST00000393161
  CDS Start-End: 30-1451
ggagcctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaaatgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggagggccccctgctccaggtggaaggactgagtgaccttcgactagagcttcacagcaagaagatgaaccttcacttggttctcatagatgaactacaccggcacctgtacatcaaatcgactagccgagttgtgcagcgtaacaaggaaaaagggaaaatcagctccctcgtgaaagatgcttctgttcctctgattgatgttacaaacctccctactcctcgaaaattccttgatacctctcactattctactgctggaagctcaagtgtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggttgcttctagaactgctggagttactgtttgacaagtttaatgctgtagccgctgcacactctgtggtcctgggatacctgcaggacactgtagtgactccactgactcagcaggaagatatcaaactgtatgatatggcagatgtatgggtgaagatccaagatgttctacagatgctattaactgagtacttggatatgaaaaatactcgtacggcctctgaaccatcagctcaactaagctatgccagcactggacgagagtttgcagccttttttgccaagaagaaacctcaaaggccaaaaaattctcttttcaagttcgaatcgtcctcccatgccatcagtatgagcgcctatctgcgagaacagagaagggagctctatagtcggagtggagaactgcaagggtagcggcgaagaaatccaccagaaagacaatcaaagtaacattaaaaagctcaaattttacaaaagttaagttcctgccaacattttcaatttatcatacaattagaaatgtgactcagtctaacaacacccaagaggataaaaggattaaaaaaa

SEQ ID NO: 131512 - DNA, 2632 bp, Homo sapiens
  Payload ID: 5667
  Gene Symbol: EXOC5
  Gene Name: exocyst complex component 5
  ENST ID: ENST00000340918
  CDS Start-End: 252-2183
acttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgacctt

SEQ ID NO: 131513 - DNA, 8513 bp, Homo sapiens
  Payload ID: 5667
  Gene Symbol: EXOC5
  Gene Name: exocyst complex component 5
  ENST ID: ENST00000413566
  CDS Start-End: 252-2387
acttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgataggcaaagcaaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggcaaacggggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttatttggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatcacaaatctttattggtattattttatatacttttccagcttgataattttcacaatagaaagagaccaaatattttgtactatattttgtgacatagaagtaaatgacaactctaccttggaagatatgaagaaatcagtgtttttatgttcaaaaactattttaaatgtcataggcttgccaattgtgttaactatttagtacattggtagtttttaaatgactaatgctggagtgaaaatgtaaggcaaaatatttagtatattaacagtagatagtcattttcatgtaatcagaattgcatgttaagggttttaaaagctgtcataactcttaccttttatttctaccagtgatcaatcatttctctttacaaatttagggaggaaacaactgttcaaatgtataggggacagaaacctgacatttagagaacagaaattttaattgccaaattaaagcagctaggctgcccctgggcttaacaaaattcctatttttgaactagacccgaggtattttatcattattatttgataggtaccattaacctttgttttgtgattatcgacttttggggggaaagatgagtaattaaacacactcgcccattttctaagtggtttagaaggttgcagtctgcctcaccatacaaagccagtttaaataggaatatatcacatcatacttcacatagcagtcaacctcagaggaaagtcatttattcagaaggcatagattttgctagacagcagtgatgcattacaaatatataattatttgcactaatatttgagcaggtggaatggattagaacatggtcaacatcatgctgctgataacatgtatttttctatattaatatgtactgtgcaacatgtattaaaattgtcaataattcattttagccaagatactaatatttatattactgtgtttaagagacagtatccaactgagccacttttaatttaaaagtctgaaactggaattaagtttactttcaaaaatcacttaaattactttataatcagtgaaaggtcagtaaaatgtagaattataagtgcctagtgacttaataggaggaaatatggagggttaaggaaggaagtaggaacctggaataagaaagctaagtttcatttatagttccaatgagtgactttctttgttttcaccactgggaatcttaaatgaagaaagtgtcgtatcccttccagttatctttatgttaataaactaagtgaagtttggatagaactaacaaaggaattagtctccattggtggacttccagagttttgagattaaactttgagaggtgagaagccttcctgatgcccctgtaatcttaaattggcaggtgcctctaagtgaggccatccctctttgcctgcctatcattttaatctttatactgtaactggttcctttcaactctggccttttattgtagcacttttatcaagtctgcagcttcccagctacttgggaggctgaggtgggaagaacacttgaagctaggagttcaagaccactctgggcaacatagtgagtccctgtttttagaaaaataaataacctttaggtttttgctatagaaaatatccaaatagagtctggacaatgctggatgtaaagaaaactgtgaagctacctctaagcatattgtttgtgaatactgtgtaccatttagaggataacatgggggattcacatgaagttatgtgaaaatattttataaggaataatacctaagtgcctctcttaagttctccagtagaatgtattttcaatttttgccacaagggggagaagttatttttatagtaatatgtacatttttttattttaaaaatagaattcacacaactttacagcatctatgaacattttgctatcccaattatgtgtgtgtgtgcatgtgtgtaaacaagattctgaaagtcttgcatgagaaaaatttcaaaggaaattaataacaaaaccaaaacagttttgaagaacatgtgcacagtggacacaggaattgaacaaagtttaccatgattaacattatgttttcttagttatatatcacattgaattcctttatcaactctaataagaatctactgattagtgttctacattctgctttttaaagaaaaatttttgaaacaatcagacttaacagaagggttgtaaatactgtacaaataaaatttttcccttttg

SEQ ID NO: 131514 - DNA, 2349 bp, Homo sapiens
  Payload ID: 5667
  Gene Symbol: EXOC5
  Gene Name: exocyst complex component 5
  ENST ID: ENST00000555148
  CDS Start-End: 190-324
aagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcag

SEQ ID NO: 131515 - DNA, 518 bp, Homo sapiens
  Payload ID: 5667
  Gene Symbol: EXOC5
  Gene Name: exocyst complex component 5
  ENST ID: ENST00000556318
  CDS Start-End: 333-518
gtgcttggggccgaggtgggctgggcggccggtcggcagagaggggaagccgggtgtcccaagggaggagggttgcttttgtttgtgggggcaagagggaaagtctggaaggttcgggtgttggaagatgtctactccggatgagtagtgggaagggctgactcaggacgaggaaagagagccaggagcctcaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagtta

SEQ ID NO: 131516 - DNA, 10589 bp, Homo sapiens
  Payload ID: 5667
  Gene Symbol: EXOC5
  Gene Name: exocyst complex component 5
  Uniprot ID: O00471
  ENST ID: ENST00000621441
  CDS Start-End: 361-2487
aaggatcaaagttcctcatacacggtagcgtcgagccttttttcggttctttcgccgctcgttttattcgccggcccctcccgacaacctccctggcgcgcgcagttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttatttggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatcacaaatctttattggtattattttatatacttttccagcttgataattttcacaatagaaagagaccaaatattttgtactatattttgtgacatagaagtaaatgacaactctaccttggaagatatgaagaaatcagtgtttttatgttcaaaaactattttaaatgtcataggcttgccaattgtgttaactatttagtacattggtagtttttaaatgactaatgctggagtgaaaatgtaaggcaaaatatttagtatattaacagtagatagtcattttcatgtaatcagaattgcatgttaagggttttaaaagctgtcataactcttaccttttatttctaccagtgatcaatcatttctctttacaaatttagggaggaaacaactgttcaaatgtataggggacagaaacctgacatttagagaacagaaattttaattgccaaattaaagcagctaggctgcccctgggcttaacaaaattcctatttttgaactagacccgaggtattttatcattattatttgataggtaccattaacctttgttttgtgattatcgacttttggggggaaagatgagtaattaaacacactcgcccattttctaagtggtttagaaggttgcagtctgcctcaccatacaaagccagtttaaataggaatatatcacatcatacttcacatagcagtcaacctcagaggaaagtcatttattcagaaggcatagattttgctagacagcagtgatgcattacaaatatataattatttgcactaatatttgagcaggtggaatggattagaacatggtcaacatcatgctgctgataacatgtatttttctatattaatatgtactgtgcaacatgtattaaaattgtcaataattcattttagccaagatactaatatttatattactgtgtttaagagacagtatccaactgagccacttttaatttaaaagtctgaaactggaattaagtttactttcaaaaatcacttaaattactttataatcagtgaaaggtcagtaaaatgtagaattataagtgcctagtgacttaataggaggaaatatggagggttaaggaaggaagtaggaacctggaataagaaagctaagtttcatttatagttccaatgagtgactttctttgttttcaccactgggaatcttaaatgaagaaagtgtcgtatcccttccagttatctttatgttaataaactaagtgaagtttggatagaactaacaaaggaattagtctccattggtggacttccagagttttgagattaaactttgagaggtgagaagccttcctgatgcccctgtaatcttaaattggcaggtgcctctaagtgaggccatccctctttgcctgcctatcattttaatctttatactgtaactggttcctttcaactctggccttttattgtagcacttttatcaagtctgcagcttcccagctacttgggaggctgaggtgggaagaacacttgaagctaggagttcaagaccactctgggcaacatagtgagtccctgtttttagaaaaataaataacctttaggtttttgctatagaaaatatccaaatagagtctggacaatgctggatgtaaagaaaactgtgaagctacctctaagcatattgtttgtgaatactgtgtaccatttagaggataacatgggggattcacatgaagttatgtgaaaatattttataaggaataatacctaagtgcctctcttaagttctccagtagaatgtattttcaatttttgccacaagggggagaagttatttttatagtaatatgtacatttttttattttaaaaatagaattcacacaactttacagcatctatgaacattttgctatcccaattatgtgtgtgtgtgcatgtgtgtaaacaagattctgaaagtcttgcatgagaaaaatttcaaaggaaattaataacaaaaccaaaacagttttgaagaacatgtgcacagtggacacaggaattgaacaaagtttaccatgattaacattatgttttcttagttatatatcacattgaattcctttatcaactctaataagaatctactgattagtgttctacattctgctttttaaagaaaaatttttgaaacaatcagacttaacagaagggttgtaaatactgtacaaataaaatttttcccttttgagaataagtcgctgtcatgatgctgcaccaccctccaatacttttgtatttccaagaagaaagaatgcttcagtataactacaatacatgaaaattgggaagttaacattgacatattactactatctaatcctcagacaccaatcattttactagctgtcctaattccttttaaggatctcagttcaaaatcatgtattgctttaggttgtagtggctctagtctcattcattctgacacagttccacagtctttccttgacttttttgactctggacatttttatagattatagggtagttactttgtaaaacacccctacatttggatttctgtttccacgtaattagattctgtttgtgctttttggcagacataccacggatgcaactctgtgttattgttgcatcctatcacatagtacacaatttcaatttgccccatttctgatgatgttcatttttatcactttcttaaggtactatttaccaggcttctccactttaaaactattacttttccctttgtaaatattttggaggtagatatatattaatagatacagacatatataggtcccccttatttatttatttgcagacagagtctcgctctgttgcccaagctggagtgcggtggcgtgatctcagctcactgcaacctctacctcctgggttcaagcgattctcccacctcagcctcccaagtagctaggactacaggcacatgccaccatgcctggccaatttttctatttgtagtagaaatggggttttgccgtgttggtcaggctggtgtcaaactcctagccttaagtgatctgcccacctcaacctcccaaagtcctgggattacaggtgtgagccaccttaaccagccatcctttatatatatatatatatatatatatataatattaatatatataaaaatatatgtatatgtgtggtgtgtgtgtatatatatacatatgtgtgtgtatatacacgtgtgtttatacacgtgtgtgtacatatacacgcgtgtgtatatatacacacgtgtgtgtgtgtatatatatatactaatcagaattctcttgatatcactatgtattcatagttttctgttcaactaattataatctgtcattttaccaaatctcaaattatcccaaatttggtcagaagtagcctcttcaggttgtctcctgtgtcgttttggcatgttcccatcatttttacagcaatttattctgggcacaacaggattttccaaggtcatcttgtacttgccttgccccagctctggaatcagccattcctccaccttttagtgaaattggcagttagaaatcaagatttgtgcatgagatgtgcttattattattgagatgtctcaccctactctttctcaatagataatgctagggggctttatgtgtgcatacacacacacacactcacgcatattttaaatatacacccacacccatgcgcccctctgcaacatcttcctcacctcacttgagcttccatactccatactgggcttcccctctctctggaggagaccatcctcatctcacatagctcttgaagttttggctttaggaccaaattgagggaataagaatggtcattgcagaaatcctgtaaaaattttaaaatattaaatttaaaaattacaattttatcacgcagaaacaactatatttttggtggaagttttttttttttttttttaatgtagtgagcaaattagtaaagctgaattgaggagggggtaaagtgttatgcccaagacacagaacttacattttgaaagaattaaatttgaaatgcataccgtatgtttttctattatacaatctccttgctactgtaattgctatttaataagagtgcatcagagaaactgtatgaatggaaacctgaccattaagcactgaataccaataggatatttttactaataaagttcaaaggaaaaatga

SEQ ID NO: 131517 - DNA, 3564 bp, Homo sapiens
  Payload ID: 5668
  Gene Symbol: EXOC6
  Gene Name: exocyst complex component 6
  Uniprot ID: Q8TAG9
  ENST ID: ENST00000260762
  CDS Start-End: 15-2429
agcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacatgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaa

SEQ ID NO: 131518 - DNA, 2714 bp, Homo sapiens
  Payload ID: 5668
  Gene Symbol: EXOC6
  Gene Name: exocyst complex component 6
  ENST ID: ENST00000371543
  CDS Start-End: 50-511
gtcgttcccgcggcgccgcgcctcgctggctcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtgagttggtttttttcctattgttttaaataagaatttttttctattattgaaaggacagatacatttactataaatcatagtgaatcatgagttttgctttcttcattacactaacctttgtacttaaaatttgcgcatcaggataatccactaaagcaaatcttagccttttattaataaatcattgtcctttataaatgatatcaaggattggtaatgttgatcaagtacaaatagccgaacaggaatgaaaatattgattagcttaccaacatactaatattgcatgtaactaagggctaagtgcatattgtggaaggaaaagagtgtaggcagttatattttgacagtctgggtgaatgtagtagttcacattctgttttataactcaaatgcatatatgacagttgaaaaagaaagtaatttaaagtagtttattgattgccataggagcattggatatagtgatgtttaaaatattttaaagacgaacagttttggccaggtgtcatggctcatgcttgtaatcccggcactttgggagtctgaggcaaggggatcacttgaacccaggagtttgagaccagcgtgggcaatatagggagacctcatttcacctccccacccccttccccccaaaaaacaaaagaaaaaaaacaaatgattcaaaagtaacatagaaaaaccagaataaattagacaatttggactagggaaaaaatgatttcttcttggttagtaactacttaattatcagaacacatcttatacagacctatagtaaaagatgtgtgtatgtcctgcttcattgtgctacatgttgaatttcattaggctttaccagttaatacaatttagtagaatgattttttccctgtaataaacaagccaaaaactattctgaaagtcttattttctttcacgtatgtattaataatatattctctttttaaatcaatgttatatatcctcacattttaaagattcaaataattttcctacgcgtttgctgccaaaaaaaaaaaaaacagatatcacctttcctatttcccattcaccattccttctttataggagcaaaaacttttacctcttttaatggattattttggtatttatatttatgtctttaaataactaacttttaattattaccatattattttccagtttggggcattatcggtttttcagtaatataatctaatatttatactcacattttctcaactatccccaaaatgtcttacgtctttttccctccctgaaaacattgatttgtatgtgttcttttgtcccttttaatctagaacagtcctcctgttctttgtttttttcatggaagagtgcaggtcagttctcttgtagaccagggcattttggatttatctagttgtttcttcatgtttagattcaagttaaaaggttttggcaagagtatagcataagtgatacctcacattgcatgacatcaggaggcttataaagtcatgttgtccttaggttatgctaaatttgatcatttggttaaggggaagtctaccagatgtcttttgaaaaggtatatttttctctttgcaattaataagtaatatgtgggtcctgtttcctaacaggttttcacccagtagttttatcattcttgccttaatccgttattatattggatttacaagatgttgatttaaaaaattctattatttcttaaacatttattaactggctgttttatatataaagaagagctttttattccccaccaccaccttttttctttttttccgattatggctgtgaacttacgcatttttaaaataaatatattataatttattattgtcattattcattttgatgcacaaattgtttcaaatttaacaagagaaacttctcaagccaattcctgtgtctttgtctttgagtatttttgtgtttattgtatcgtaagatgttccaagctctcattgtgccttttttttttttttttgcctcagatctggaagcagccattctccagggtaccctagctccttttagtattaatggtatttagaaactaagatgtatgggttgggagcagtggctcacacctgtaatctcagcactttgggaggctaaggcaggtggatcgcttaagctcaagagtttgagaccagcctggcccgtatggtaaaaccccatctctactgaaaaaaaaaaaaaaa

SEQ ID NO: 131519 - DNA, 3564 bp, Homo sapiens
  Payload ID: 5668
  Gene Symbol: EXOC6
  Gene Name: exocyst complex component 6
  Uniprot ID: Q8TAG9
  ENST ID: ENST00000371552
  CDS Start-End: 27-2426
ctggaaaattaggggcctgtcgagcgatgttggaagaagaaacagatcaaacctatgagaatgtcctggctgagattcagtctttcgaactgcctgttgaagctactttaaggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacatgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgc

SEQ ID NO: 131520 - DNA, 3310 bp, Homo sapiens
  Payload ID: 5668
  Gene Symbol: EXOC6
  Gene Name: exocyst complex component 6
  ENST ID: ENST00000443748
  CDS Start-End: 67-2172
acttggagctcgcccccgtcgttcccgcggcgccgcgcctcgctggctcctcagcttccagccaaaatggcggagaacagcgagagtctgggcaccgtccccgagcacgagcggatcttgcaggagatcgagagcaccgacaccgcctgtgtggggcccaccctccggtctgtgtatgatgaccaaccaaatgcgcacaagaagtttatggaaaagttagatgcttgtatccgtaatcatgacaaggaaattgaaaagatgtgtaattttcatcatcagggttttgtagatgctattacagaactccttaaagtaaggactgatgcagaaaaactgaaggtgcaagttactgataccaaccgaaggtttcaagatgctggaaaagaggtgatagtccacacagaagatatcattcgatgtagaattcagcagagaaatattacaactgtagtagaaaaattgcagttatgccttcctgtgctagaaatgtacagtaagctgaaagaacagatgagtgccaaaaggtactattctgccctaaaaactatggaacaattagagaatgtgtactttccctgggttagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagggtgacgaggaaacatttgaaaactattatcgaaaacaaagaaagaaacaagcaagactggtattgcaaccccagtcgaatatgggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacatgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgc

SEQ ID NO: 131521 - DNA, 216 bp, Homo sapiens
  Payload ID: 5668
  Gene Symbol: EXOC6
  Gene Name: exocyst complex component 6
  ENST ID: ENST00000458552
  CDS Start-End: 1-216
gggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaa

SEQ ID NO: 131522 - DNA, 1799 bp, Homo sapiens
  Payload ID: 5668
  Gene Symbol: EXOC6
  Gene Name: exocyst complex component 6
  ENST ID: ENST00000495132
  CDS Start-End: 47-1261
acaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaatatgaggtgttgctgtgttgcccagactggtctcaaactcctggcctcaagtcatcctcctgccttggcatcccaaaatgctggaattagaggcgtgagctactgtgcctggccatttttataagcttttaagctgaaatgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggattttt

SEQ ID NO: 131523 - DNA, 5918 bp, Homo sapiens
  Payload ID: 5669
  Gene Symbol: EXOC6B
  Gene Name: exocyst complex component 6B
  Uniprot ID: Q9Y2D4
  ENST ID: ENST00000272427
  CDS Start-End: 132-2567
agggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcgacctgctgcagcctctgtgtcagtctggggtccagccccagctgaccctgcatttgtgcattcttcttcaaagagagcatatgtatttttttattaacccctgtgcagtattcacataacatttccctatagtaaaagaggcacaagaataagcaagtacatgagatgttgctaggctgggactcaggggaagttattactacactatctgtgttatcttagagatggtggtatcatcaattccacagtgatgaaccacctttcatccatggctctaaagcttaggtctggggcttaggaaccataaaaagtgggtatctggcgctgggaggtagagtgagtaagcaaaaggatactaaaatatgtcctgttcactcttggatgcccattcaccacatagatgaggctgattcttctcaatacaaggaaagggcatggcaaacattactatttagtacactaagggcagctctggagggtcatctcctcagtctgctgactttcactggcttgtgaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgcttctggggagggaagtacttccttgcccctccccaacccccctacctcaccatatcctatcatatcttgatagtcatggggaagaggatgtgcacacagacatacaaatttcctcaaagctggagagaccaggctacatgtgagctcatagatgctgctgaggctcatcctgagggctggatggttggccagggtttcagaatgagggtaagggatgagcactgccacccagaacttgataagccaagagaaggcaggagccaaaatggcatcgccaagctctcatctttgttgaaacaagtgagaaacgattatattaatctgaagttctattgcttgagaagagttcaaaacacttctctttgctagtacccagtttgcagcaagatctcttcagctttaagtgctgagagactttgaagtggaaatggagagatgtgtaagcatggcacagtgtttgtctttttagaggatcatcattgctggtctggtctcaaacctctgccttggaagaactgtgctatacaggaaaaagtgaacaaggtggaggaataggggttattctgcacagaagtcccatgaaaggaaaagcttattcaagctcaagacataaagatggaccctttgatatatcttctctccattcttagtctgccttcaccttatctaacaaaaaacaacatgcagctactgagttgtatgtagagacatactcttggtgggccagggaaggtaaaaacagggaccagcaatgtcaagtttttgaactagaaaagtgggatgtttttagttttgtctataacctgtagctgggccaacccttgagaggacttgtgcaaagcatgtgtgcccagacccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagcca

SEQ ID NO: 131524 - DNA, 1372 bp, Homo sapiens
  Payload ID: 5669
  Gene Symbol: EXOC6B
  Gene Name: exocyst complex component 6B
  ENST ID: ENST00000410112
  CDS Start-End: 96-218
gcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcagaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaag

SEQ ID NO: 131525 - DNA, 5795 bp, Homo sapiens
  Payload ID: 5669
  Gene Symbol: EXOC6B
  Gene Name: exocyst complex component 6B
  ENST ID: ENST00000410104
  CDS Start-End: 132-2177
agggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctgtaagtggcagttgcttactttgtcctttatatataaaaagatttccttataatttagtttggtgaaagatgttagtttctgctgtaactacccaggaagattttcagtatataaaggcgcatgctatatttattaacctttaatgatatgtagaggctacttccatcattttttcattgacctttgcatttttttcatctgaaaatggttcctggtattatgtctgcttatcttcctatgatgttcaaggtaattagtacaaagacaatataaaagccttggtagaattaaaaaaagaaacttagttagaatttcagatatgtatattttagttttagaatattctttaacttttttatataaactgaaattctttgatgaaatgctccatcttttttatctaatttgtctatgttttctctgttttcttaagcatattaattatagacattcaaaatcattctttactacttcttatatatattatacatacatattggtggattttttttctcttggttttcagtgatatggtcctgtctgtttctaatatttttcggttgatgttagacattgtataaaatatgtagagattccaggtggtgttatcttccaccagaaaaggttcatgttttcctttacttagtaaatagaatgggcaggtgggttgtggtttgaagctgaccaccttagtaccatcatggactgatttggattaatattgggttgcagttgtagtgtactttgtttgcccttgttggtaggatatggctctgcagagcttttaaaaactgcctgatatgtcattgtctttttagcaccaaagaggactatagaaattcctgctcttcacagaaaccttgtctgttcagcctcctgtactctttcgttttagaatctggtaaatgtcttgagaaggagacttagcagtacccagtatcagcaattgctgatgggaaaaaaagtgttggggattgtcagtgttactttaccatccctaatgaggtttcagctcctatgtgatctgaatgtttgtgtaccccaaaaaatcatatgttgaatctaataaccagtgtgattacattaggaggtgaggccttgggaggtgatagattatgatggtagagcctcgcaaatgggattagtatacttataaaagagacttcagagagctgccttgttccttgtggccatgtgaggatacggggatacaggaagaagactccttttttatttcgcactaggaaataggccttcatcagacaccgaatctgctgataccttgatgttggacttccaagcctccagaactgtgagaattcttttgtttataagctaccagtctatgggattttgttacattattctgaatggactaagatagctcctgtcatttttaggcattcttctactagtgagtctttttctctgaaacactgtgaaactgtgagaaatctccttgcttttcaaagattttggcttaaacccttattttcctcagccgtttagctttagaattcagtaaatatcttgagggtaaaactagtcctcaaacctctaactgtggcactctagtctgttggaagcagcaaagattccaagtttttttcgccccctagtagttagtctctgcctggttttaagattctcagtctgttgcccttgtctacgttcctcaaatgcccacaaggaaagctgcagattttcacctcacctttaaaaggttttgtcctctctgcagttttattccctttagtcttcattgcttcacagcacctgatgccttttaatatgttttttctacatgttttacttcctctcctagttgttcctagtgggagcatttatctgcagaaaattatgtcattttgtctagctttatcctgataccaaagccagacaaaaagagcacacacaaaaaaactatgagttaatctcacaattatggataaaagtaaaataaataaaattttagcaagtcaattcccagtgttttaagaaagtaattttgtactagtgtgtaggatttattccagaaatgcaaggatggtttgatattttaaaaaaatatgttaatataatttatcatattactaggtgagggagatacagtttcttgatgtattctagaaagacattttattacatccaggctacattcttgatttaaaaacaaagtttactaaattccaagcagtataatattttaataacaaaataaagaacatctatttgaaatttagtggccaccatagattgaacagtagaacaataaaacatttattttcattgacaacaggaattgggtgaagatgcttctcaccaacactttagaagttctataaaataaatgtaaaaaaagaataaattacattataatgagccatgcatgtcttagtccattcctgctcccataacaagatactgtagactgagaaatttataaacaacagaaatttgtttctcacagttctggaggctgcaaagtccaatattaagatgtcagcagattcagtgtctgataaagtcctgttactcataaatggcacctctgtatccttacgtggcagagaaggcaaaaaggacaaactcactcccccaatcccttctataaggcactaatccaattaatgagtgatgtaatcacttctgaaatttttgtgccctcccccacaaaaattaaaaattaaaaaaaataacaaagttgcattggggattaaatttcaatatgaattttggcaaggctcaaacatttcaaaccatagcacatgcatattattattcataggttattattatctaaatagaacatactaaaaattcattaagaccaataagagtttaggttagatgattcacttagaaaacaaataaacttttcttatattagcaatgcccacatagaaaatatagtgtcaaaagtgtcttatttactattgggacatagatataatttttctatgcagctacttagcaagtcaatttagaaataatgtgacaacatcacagagtaatataaaagagactttcttatgcacaaatatatatggtattccaggatgggagtatttcattctgtagaaagttttttcaaatttaatctaattgcagtgagtatcaagtaaatttgtttagggaagaatcttaatgaaatcattctgaaattcatttgtaagcaaaaatggacaatatttggtaaaaaatgataacatgaacataatttgtaactctattaataagacatacaaattaagcttgtgtgatatttttgactataaactactcagaaataagaaaatggtaacactccttgtttataagaaatatttgtggaaataggtattttcatacctgctgctaggggtctagttattgtagtctttttggagtcagtttttcaatatgcctcagaaaccccttaaaatgtgcttacctttttactatgtaattccccttttagaatttgaacttaatgaaataatcatgattgtattataatattcagatgtaactatatttaatacaatgtattttgtatagcgaggagtaggtataaattaaaaatccaacaaacaaatgtgttcacaaactaaattattgtatattcatataatgtgatattcattaaattaatgtaaatttatatttattcattaaaaatatattcgttatttcttaactgg

SEQ ID NO: 131526 - DNA, 2583 bp, Homo sapiens
  Payload ID: 5669
  Gene Symbol: EXOC6B
  Gene Name: exocyst complex component 6B
  ENST ID: ENST00000634650
  CDS Start-End: 110-2557
agccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaaaatcaagtgacggatactaatagaaaactacaacatgagggaaaggaactggtaatagcaatggaagagctgaagcagtgtcgactacaacagagaaatatttctgccactgttgataaattaatgctgtgtcttccagtcctagagatgtacagcaaactgagggaccagatgaaaactaaaaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagcccagcagcaaagaaacctggataacatcgtcttgcaacaacccagaataggtagcaagaggaaatctaagaaagatgcatatataatctttgatacagagatagaaagtactagtccgaagtctgaacaggattcaggaattctggatgttgaagacgaggaagatgatgaagaggtacctggggcccaagatttggtggatttctctccagtttatcgatgtctacatatatattctgtcctgggtgcccgggaaacatttgagaattactaccgaaaacagaggcgaaaacaggctcgtttggtacttcaacctccatctaacatgcatgaaactttagatggctacaggaagtattttaatcaaattgtaggcttttttgtggttgaagatcacattttacatacaacccagggcttagtaaatagagcctacattgatgaactgtgggaaatggcactttcaaaaaccatcgcagcactccgtacccactcgtcttactgttctgatccaaaccttgtgttagatttgaagaacctcattgtgctttttgctgacacacttcaggtgtatggtttccctgtaaatcagctttttgacatgctgttagaaatcagagaccaatatagtgaaactctgctaaagaagtgggcaggtattttcagaaacatacttgattctgacaactacagtcctataccagtaacaagtgaagagatgtacaaaaaggtggtaggacaattcccatttcaagatatagaactggaaaagcaaccatttccaaaaaagtttcctttctctgaatttgtgccaaaagtttacaaccaaattaaagaatttatctacgcttgtctgaagttttcagaagatcttcatctaagctcaactgaagttgatgacatgattcggaaatcaacaaacctgttgctaaccaggactctgagcaactctctgcagaatgtaattaaaaggaagaatattgggcttactgagcttgttcagattattatcaatacaacacatttggagaaatcctgtaagtacttggaagaatttatcaccaacatcactaatgtgcttccagagacagttcacactaccaagctctatggcaccacaacttttaaggatgctagacatgcagctgaagaagagatttataccaacttaaaccagaagattgaccagttcctacagctggcagactatgactggatgaccggagatttgggcaacaaagctagtgattacctggtagacctcattgcctttcttcgtagcacctttgctgtattcacacaccttcctggaaaggtggcccagacagcgtgtatgtcagcttgcaagcatttagccacatccttgatgcaacttttgttggaagctgaagtgcggcagctcaccttgggagcattacagcagttcaacttggacgtcagagaatgtgaacagtttgccagatccggcccggtgcctgggttccaggaggacacgctgcagttggccttcatcgacttgagacaacttttggatcttttcatccagtgggattggtcaacctaccttgctgactatggtcagcccaactgcaagtacctccgggtaaacccagtgactgctctgaccctgcttgagaagatatctagagagatgaaggatactagccgcaagaacaacatgtttgcacagtttcggaaaaatgagcgagacaagcagaaactcattgacaccgtggccaagcagctccgaggactcatcagcagccaccactcatgaagggtgaccccggacccacagaggcg

SEQ ID NO: 131527 - DNA, 4596 bp, Homo sapiens
  Payload ID: 5670
  Gene Symbol: EXOC7
  Gene Name: exocyst complex component 7
  Uniprot ID: Q9UPT5
  ENST ID: ENST00000332065
  CDS Start-End: 4-1965
gcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttc

SEQ ID NO: 131528 - DNA, 3519 bp, Homo sapiens
  Payload ID: 5670
  Gene Symbol: EXOC7
  Gene Name: exocyst complex component 7
  Uniprot ID: Q9UPT5
  ENST ID: ENST00000335146
  CDS Start-End: 55-2262
ggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggcttcttccctgtaccccaaggggcggcctgcctggcccctggataaacgctgcttgtgtttgtgcggccgacatctcgccaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaacccca

SEQ ID NO: 131529 - DNA, 1924 bp, Homo sapiens
  Payload ID: 5670
  Gene Symbol: EXOC7
  Gene Name: exocyst complex component 7
  ENST ID: ENST00000357231
  CDS Start-End: 1-1853
tatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaaggtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgc

SEQ ID NO: 131530 - DNA, 2208 bp, Homo sapiens
  Payload ID: 5670
  Gene Symbol: EXOC7
  Gene Name: exocyst complex component 7
  ENST ID: ENST00000405575
  CDS Start-End: 55-2136
ggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcc

SEQ ID NO: 131531 - DNA, 718 bp, Homo sapiens
  Payload ID: 5670
  Gene Symbol: EXOC7
  Gene Name: exocyst complex component 7
  ENST ID: ENST00000406660
  CDS Start-End: 43-522
gaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtggtaaggggtccgcagaataacgtgagaagcttggggatatcagtctctgccctggtctcatgagggacatggagccagcttgaggatgtatgcagtagaatacacagaaggatatagcacagtacatcctataggcattaggatctctgcttcaagaattgcacattttttattattaaaaattctttattataaaacttgttaatgtattataaaaattaaattataaattacatataaaatataaacttaacatttg

SEQ ID NO: 131532 - DNA, 583 bp, Homo sapiens
  Payload ID: 5670
  Gene Symbol: EXOC7
  Gene Name: exocyst complex component 7
  ENST ID: ENST00000442951
  CDS Start-End: 221-583
agttctggaatgggcagcgacggaggcagtgtgtgggtttatctagcaacagtttggcatctctcctgcctagccccctccccatgttccgtaccctcactgaggaggctgcacttcccactggcctggacttgctgctttctgtctaagctcgccattcttccttctctccttctgcaaacactcagtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatc

SEQ ID NO: 131533 - DNA, 543 bp, Homo sapiens
  Payload ID: 5670
  Gene Symbol: EXOC7
  Gene Name: exocyst complex component 7
  ENST ID: ENST00000420116
  CDS Start-End: 178-543
agcaacagtttggcatctctcctgcctagccccctccccatgttccgtaccctcactgaggaggctgcacttcccactggcctggacttgctgctttctgtctaagctcgccattcttccttctctccttctgcaaacactcaccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcat

SEQ ID NO: 131534 - DNA, 2031 bp, Homo sapiens
  Payload ID: 5670
  Gene Symbol: EXOC7
  Gene Name: exocyst complex component 7
  Uniprot ID: Q9UPT5
  ENST ID: ENST00000411744
  CDS Start-End: 1-2031
atgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctga

SEQ ID NO: 131535 - DNA, 2260 bp, Homo sapiens
  Payload ID: 5670
  Gene Symbol: EXOC7
  Gene Name: exocyst complex component 7
  ENST ID: ENST00000467929
  CDS Start-End: 161-2131
gaggagatggggttgggggctaggccgtggggttgggacgcagtggtctcctttagcttctggtttctggtgatgtcctccccttgcctgcccccaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagttcttggggacacatacaatattcctttagacccccgagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgg

SEQ ID NO: 131536 - DNA, 645 bp, Homo sapiens
  Payload ID: 5670
  Gene Symbol: EXOC7
  Gene Name: exocyst complex component 7
  ENST ID: ENST00000592559
  CDS Start-End: 1-102
tctggggttccctactcccctgctatccccaacaagaggaaagacacacctaccaagaagccagtcaagcggccaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaa

SEQ ID NO: 131537 - DNA, 820 bp, Homo sapiens
  Payload ID: 5670
  Gene Symbol: EXOC7
  Gene Name: exocyst complex component 7
  ENST ID: ENST00000589507
  CDS Start-End: 317-820
gcccgggctcgcctcacctccccgcctgcttaagccctcccggagcgctcggggttcgacccccgagcacggcgggaggagggcgcccccctgcggcacagccacgtccacgaagcccctcccggggttctagaaagcggaggcctccgaaggaaagaccaagatgcagagagatgtctaaaaggtgccagaaggtgactatccagccctggtatcactgcctggtgatttcgtttctttgatcttcacgaatggcctcactggctgtgatttggacagaaatcagctgccacgtgcaacattctcccatgggaacatgtgtccgcagtacctatctcagagcccaaatccttcctgccccacagccttctcctggaacctgccttgggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggcc

SEQ ID NO: 131538 - DNA, 4751 bp, Homo sapiens
  Payload ID: 5670
  Gene Symbol: EXOC7
  Gene Name: exocyst complex component 7
  Uniprot ID: Q9UPT5
  ENST ID: ENST00000589210
  CDS Start-End: 67-2121
ggacgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccactt

SEQ ID NO: 131539 - DNA, 3353 bp, Homo sapiens
  Payload ID: 5670
  Gene Symbol: EXOC7
  Gene Name: exocyst complex component 7
  ENST ID: ENST00000607838
  CDS Start-End: 127-2097
gcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagttcttggggacacatacaatattcctttagacccccgagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaacccc

SEQ ID NO: 131540 - DNA, 2124 bp, Homo sapiens
  Payload ID: 5670
  Gene Symbol: EXOC7
  Gene Name: exocyst complex component 7
  ENST ID: ENST00000634349
  CDS Start-End: 1-2124
atgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctga

SEQ ID NO: 131541 - DNA, 5100 bp, Homo sapiens
  Payload ID: 5671
  Gene Symbol: EXOC8
  Gene Name: exocyst complex component 8
  Uniprot ID: Q8IYI6
  ENST ID: ENST00000366645
  CDS Start-End: 108-2285
attcctgcttcctcagcccaggagctcggttggccttgggtgggtctagacagccgcggcggctgcggcgccgatagtgacagtgagtgcgtgagacccggagagaaatggcgatggcgatgtcggacagtggggcgagccgcctgcgtcggcagctggagtcagggggttttgaggcgcggctgtacgtgaagcagctctcgcagcagtcggatggggaccgggacctccaggagcaccggcagcgcatccaggcgctggcggaggagacggcgcagaacctgaagcgcaacgtctaccagaactaccggcagttcatagagacggcccgcgagatctcctacctggagagcgagatgtaccagctcagccatttgctgaccgagcagaaaagcagcctggagagcatcccgcttacgttgctgcctgccgctgctgccgccggagccgccgccgcctctggaggggaggagggagtcggtggggcggggggccgagaccacctccgaggccaggccggctttttctccacccccgggggtgcctcccgcgacggctccggtccaggcgaggaaggaaagcagcgcactctcaccaccctgcttgagaaggtggaaggctgcaggcatctgctggagacgccgggacagtacttggtgtacaatggggacctagtggaatacgatgcggaccacatggcccaactgcagcgggtgcacggctttctcatgaacgattgcttgttggtggctacctggctgcctcagcggcgtgggatgtatcgctacaacgctctctattccctagatggtttggccgtagtcaatgtcaaggacaacccgcccatgaaggacatgttcaagctgcttatgttccccgagagccgtattttccaggccgaaaatgctaaaatcaaacgagagtggctggaagtgctggaggacaccaagagggccctcagtgagaaaaggcgaagggagcaggaggaggcagcggcccctcgagggccaccccaagtgacttccaaggccactaacccatttgaggatgacgaagaagaagaaccagctgttcctgaggtagaggaagagaaggtggacctctccatggaatggatccaggagttacctgaagacctggatgtctgcattgcgcagagagactttgaaggggcggttgacctgctggataaattgaaccattacctggaagataaacctagcccacctcctgtaaaagaactaagggccaaagtggaggagcgagttcgacagctcactgaggtgctagttttcgaactctccccagatcgttccctgagaggtggtccgaaggctactcgcagagcagtttcgcaactgatccggctgggccagtgcacgaaggcctgtgagctatttttgagaaacagggcagccgctgttcatactgcaattcgtcagcttcgcatcgaaggtgccactttactctatattcataagctgtgccatgtcttctttaccagccttctcgagactgcaagagaatttgagatcgattttgcaggcactgacagcggctgctactctgcctttgtggtctgggcaagatcagccatgggcatgttcgtggatgcttttagcaagcaggtgtttgatagtaaggagagcctctctacagcagctgagtgtgtaaaagtggctaaggagcattgccagcaactgggtgatatcggactggatctcaccttcatcatccatgcccttctggtgaaagacatccaaggggccttgcacagttacaaagaaatcatcattgaagccactaaacatcgcaactctgaagagatgtggaggaggatgaacttgatgacgccagaagccctgggtaagctcaaagaagagatgaaaagttgtggggtaagtaactttgagcagtacacaggggatgactgctgggtgaacctaagttacacagtggttgctttcaccaaacagaccatgggcttcttggaagaggccctgaagctgtatttcccagagctgcacatggtacttttggagagcctggtggaaatcattttggttgctgttcagcatgtggattatagtcttcgatgtgagcaggatccagagaagaaagcttttatcagacagaatgcatcctttttatatgaaacagtcctccctgtggtggagaaaaggtttgaagaaggtgtggggaaacctgccaagcaactccaagatctgaggaatgcatctagacttattcgtgtgaatcctgaaagtacaacatcagtggtctaatgcttgggtctgtttatatgtgtatatatgcagagagagagcttatatattatttatatttatattaagttgtattagcatactctatagtttcaaacacaacttgaaaattaaaagtgccctcttaaaaatacaaaaatcaaaaagaggaaaataagttaaattaagcccaagtaacaaaaatactggaattattaaaacgtatagtatgctagctatccttttaaattatgctaattctcttcttctgaaattatggtcacactatatactatagcatttcggttttatcctttgataaaacttttcttttttcttttttttttttgagacagggtctcaccccgtcgcacaggctggagtgcagtggcaaagtctcgactcactgcagccttgacctcccgggcccaggtagtcctcccacctcagcctcccatgtagcaggaaccacaggcaggcaccaccatacccagctaatttttgtattttttgtagagatggggtttcgccatgttgcccaggctagtcttttctttcttctttttttttttccccacagtatatattatacagcagtcataatatctataaatacatagagtttatgttgtgaagtttcccagttcactgaaatgttaggtttcctaaagggtacagtgccgtataaaacaacctgcctcatatatttctcctcaaaacgttggactatttgggaaaaggaaaagagttgggaaaattggttttaaggtaagttttagtcaaaagaattctttcttgaaactagctggtttgtggattcagatactctgatccttacagaatccaagaggaagctttcataaaaacaattcagcaaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatgcaaatctcagtgttctcactatgaccactctgagcagagatttggttttgtttccttttgtaacaaagtgaaaacaggtgagacaatgtgcccaaaacaaagggaagaagagaaccttctgtgactcctaaaatgttccatgctgcatttttgtttcattttttatttttccttgctttgtttttaaacatgaatataatgcttacttcaaattgtttagtaaaacaaaataactaaagaaatgtgagcttcccaaggtttctaaactatcgctgttgtatattctatagcgttccttattctttgagggaaactgtgcttgctgtgatccattttgtctctagcttctagttgtgattcttgtccataagcaccaaatttgatgcccatgatttcaaaaggtcatttcttttatctgaatgaaaatggtggtactaagactgtgaaaattatgtgaaacctaaagtagttgccaaagtggctcagggttgtaaaattcattgacttaattattcatgtgccagatcaacccctttattttctctttagctgtgcatatttaaaatattggaaagtatcagatttacagattttctttgactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttctgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacatgtactataaaagtcagtctatgtacatactgcttattgatgtgctgtgatatgagggaatctgaaatgtttcataaaaataaagcttaaaaattgtcttacactgga

SEQ ID NO: 131542 - DNA, 3192 bp, Homo sapiens
  Payload ID: 5672
  Gene Symbol: EXO1
  Gene Name: exonuclease 1
  Uniprot ID: Q9UQ84
  ENST ID: ENST00000348581
  CDS Start-End: 315-2855
gcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactac

SEQ ID NO: 131543 - DNA, 3473 bp, Homo sapiens
  Payload ID: 5672
  Gene Symbol: EXO1
  Gene Name: exonuclease 1
  Uniprot ID: Q9UQ84
  ENST ID: ENST00000366548
  CDS Start-End: 594-3134
ggaacccgcgcaaattgaaaggtcagcctttcgcgcgctgtgtaggcaagttacccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactacaa

SEQ ID NO: 131544 - DNA, 607 bp, Homo sapiens
  Payload ID: 5672
  Gene Symbol: EXO1
  Gene Name: exonuclease 1
  ENST ID: ENST00000450748
  CDS Start-End: 203-607
cttatgtaaatttcatgaactattatatccgttttcctcggagtgagagaaaactctttttagatatcatctgagagcagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaa

SEQ ID NO: 131545 - DNA, 593 bp, Homo sapiens
  Payload ID: 5672
  Gene Symbol: EXO1
  Gene Name: exonuclease 1
  ENST ID: ENST00000437497
  CDS Start-End: 96-593
acttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgatagaagacgacaagccaatcttcttaagggaaagcaacttcttcgtgaggggaaagtctcggaagctcgagagtgtttcacccggtctatcaatatcacacatgccatggcccacaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgta

SEQ ID NO: 131546 - DNA, 950 bp, Homo sapiens
  Payload ID: 5672
  Gene Symbol: EXO1
  Gene Name: exonuclease 1
  ENST ID: ENST00000423131
  CDS Start-End: 444-950
gcaagttacccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgatagaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgta

SEQ ID NO: 131547 - DNA, 628 bp, Homo sapiens
  Payload ID: 5672
  Gene Symbol: EXO1
  Gene Name: exonuclease 1
  ENST ID: ENST00000521202
  CDS Start-End: 1-623
gggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattc

SEQ ID NO: 131548 - DNA, 583 bp, Homo sapiens
  Payload ID: 5672
  Gene Symbol: EXO1
  Gene Name: exonuclease 1
  ENST ID: ENST00000519225
  CDS Start-End: 549-583
accatcggccatcagcgccagtgccactcgcgccctcaagaagccgcacggagttcgggccggcagcagcggctgcagtcgtatggcagtgagccgctgtctacccagcgagacggagagctcaggacgcaaccctatgagttggaagccgcaggaggcggaaccgggttgcgggatacgcgttgacgtcacatcctctgggcggggccgcaaggaacccgcgcaaattgaaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaaga

SEQ ID NO: 131549 - DNA, 621 bp, Homo sapiens
  Payload ID: 5672
  Gene Symbol: EXO1
  Gene Name: exonuclease 1
  ENST ID: ENST00000523590
  CDS Start-End: 337-621
ggccgtgggtgctctggccacagcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgatagaagacgacaagccaatcttcttaagggaaagcaacttcttcgtgaggggaaagtctcggaagctcgagagtgtttcacccggtctatcaatatcacacatgccatggcccacaaagtaattaaa

SEQ ID NO: 131550 - DNA, 2899 bp, Homo sapiens
  Payload ID: 5672
  Gene Symbol: EXO1
  Gene Name: exonuclease 1
  Uniprot ID: Q9UQ84
  ENST ID: ENST00000518483
  CDS Start-End: 215-2626
cgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaacttta

SEQ ID NO: 131551 - DNA, 2942 bp, Homo sapiens
  Payload ID: 5673
  Gene Symbol: EXD1
  Gene Name: exonuclease 3'-5' domain containing 1
  Uniprot ID: Q8NHP7
  ENST ID: ENST00000314992
  CDS Start-End: 192-1736
gcggacctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtggaactactagatgaagtggaacaaggctcagtgagagcaaaagcatcttctgttagtctacatgcagaaagaacctggatggagaaaatgaaagttgaagacctaaatgtatgtgagcctgcttctcctgcccctgaagcaccagctacctctctgctgaatgacctcaagtacagcccatcagaggaagaggaggtgacatacacagtcattaatcaattccagcagaagtttggtgctgcgatactccatatcaagaagcagaatgtcctgagtgtggcagcagaaggagcgaatgtatgtcgccatggcaaactgtgctggctgcaggtggccacaaattgccgagtttacttatttgacattttccttctgggaagtcgagctttccacaatggacttcagatgatactagaagacaagagaattttgaaggttatccatgattgtcgttggctttctgattgcctctctcatcagtatggaattttgctgaataatgtctttgacacacaggtagcagatgtacttcagttttccatggaaacgggtggctatcttccaaactgcatcactactttgcaggagagtttaatcaaacaccttcaagtagcccctaaatatctctcctttctagaaaagagacaaaaactaattcaggaaaatccagaagtatggttcatccgacctgtttcaccctctttactgaaaattttggccctggaagctacctacctgttaccccttcgcttggcactcctagatgagatgatgtctgacctaaccaccctggtggatggttacctaaacacgtatcgcgaagggtctgcagaccggcttggaggcactgagcctacatgtatggagctgccagaggaactgcttcaactcaaggacttccagaagcagcgcagggagaaagctgcaagagaatatagggtgaatgcacagggactcctgataaggacagtgctacagccaaagaaattagtgacagagacagcagggaaagaggagaaagtcaaaggcttcttatttggtaaaaattttaggatagataaagctccaagttttacatctcaagactttcacggggatgtgaatttactgaaagaagaatctttgaataaacaagctacaaatcctcaacatctacctcccacagaggaaggggaaaccagtgaggattccagtaacaaactcatttgcacaaagtcaaaggggtcagaggaccagagaataactcagaaagaacactttatgacacccaaacatgagtttcaggcaagtttatctttgaaagaggagacagaacagttattgatggtggaaaacaaggaagatttaaaatgcacaaaacaggctgtttcaatgtcttcctttcctcaggaaaccagagtgtctccaagtgacactttttatcctatcagaaagactgtggtttccacactccctccctgtccagccttggagaagatcgattcctggataagtccttttctaaatctgccctagagatgggcagtttgttcttaaggccatacagatggcttatttcctttgccatcagggctttccacagtgcccaggtttctcatgttgtaaatgtagtaatgcttcagtcacaggggaaaattatatcctcttgcttactcctgtgttcctggtatgcggagaatgagaatgaataagttaaataatggaagaagtataatttctgattatgtcactgtgtagaaatgttctcagtgaccagagtgcattatttttcataatttgggtttagaggatttgaagaaaggaagaatcttgggcttagtatcaggaagactccatcattttcaaattttgttttgcttcttgacttttggattcctttgaagagacctggtaaaactattaacaattcatttaaaaaattggtacctgataactttaccagtacttttttcctttttatttatttgttttatttatttttttttaccgctccttgtggagcagggctacaccataggcagtgtgcccagagtaaccacttttttcctttttaaaatataatattaactttatgtttgaatgttgaatgttttgtctgtctcttaggcaaataatgttataggaatcaataatttaatttttgttttatttgttttttgatggagtctcactctgtcacccaggctggagtgtagtggtgtaatctctgctcactgcaacctccgcctcccgggttcaagcaattctcctgcctcagcctcctgagtagctgggattacaggtgcgtgccaccacgcccggctaatttttgtatttttagtagagatggggtttcaccatgttggccaggctggtctcgaactcctgactgaccttgtggtccacctgcctttggcttccaaagtgctgggattacaggtgtgaggcacggtgcccagccaatatctttattttaatttgtttttatttcctttatttttagctggttttgtccattttcctaacaaagcagggaccctgggtttctttttagtctgtctgttatataaacttgaagcctgactccattctatttgcctggagttagtatactttcttagggtgaaaggaaggcagcttgtattgagccttttaaagtattgaatgcttgcaaattgctaacattcttttgtgtaaaataaccaataaacctgttttgtcatactctacttaaaaaaacaa

SEQ ID NO: 131552 - DNA, 2177 bp, Homo sapiens
  Payload ID: 5673
  Gene Symbol: EXD1
  Gene Name: exonuclease 3'-5' domain containing 1
  Uniprot ID: Q8NHP7
  ENST ID: ENST00000458580
  CDS Start-End: 267-1985
ctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtgtttggatgcttaaagaagattatttgaagacggcttttggaatcaattagcatggaccccagcagtgactaccatttcctcagccagattttgtggaagagggtgaaactcacattggtctgtggtgtcttcgagggtgtgcttcagcatgttgaccctaataagattgttgtcctgaagaaagtgaagaatgtggagacaggtcgaagtgtcccaggagtgaagttgttttttgggcatgagattgtgaatgtggaactactagatgaagtggaacaaggctcagtgagagcaaaagcatcttctgttagtctacatgcagaaagaacctggatggagaaaatgaaagttgaagacctaaatgtatgtgagcctgcttctcctgcccctgaagcaccagctacctctctgctgaatgacctcaagtacagcccatcagaggaagaggaggtgacatacacagtcattaatcaattccagcagaagtttggtgctgcgatactccatatcaagaagcagaatgtcctgagtgtggcagcagaaggagcgaatgtatgtcgccatggcaaactgtgctggctgcaggtggccacaaattgccgagtttacttatttgacattttccttctgggaagtcgagctttccacaatggacttcagatgatactagaagacaagagaattttgaaggttatccatgattgtcgttggctttctgattgcctctctcatcagtatggaattttgctgaataatgtctttgacacacaggtagcagatgtacttcagttttccatggaaacgggtggctatcttccaaactgcatcactactttgcaggagagtttaatcaaacaccttcaagtagcccctaaatatctctcctttctagaaaagagacaaaaactaattcaggaaaatccagaagtatggttcatccgacctgtttcaccctctttactgaaaattttggccctggaagctacctacctgttaccccttcgcttggcactcctagatgagatgatgtctgacctaaccaccctggtggatggttacctaaacacgtatcgcgaagggtctgcagaccggcttggaggcactgagcctacatgtatggagctgccagaggaactgcttcaactcaaggacttccagaagcagcgcagggagaaagctgcaagagaatatagggtgaatgcacagggactcctgataaggacagtgctacagccaaagaaattagtgacagagacagcagggaaagaggagaaagtcaaaggcttcttatttggtaaaaattttaggatagataaagctccaagttttacatctcaagactttcacggggatgtgaatttactgaaagaagaatctttgaataaacaagctacaaatcctcaacatctacctcccacagaggaaggggaaaccagtgaggattccagtaacaaactcatttgcacaaagtcaaaggggtcagaggaccagagaataactcagaaagaacactttatgacacccaaacatgagtttcaggcaagtttatctttgaaagaggagacagaacagttattgatggtggaaaacaaggaagatttaaaatgcacaaaacaggctgtttcaatgtcttcctttcctcaggaaaccagagtgtctccaagtgacactttttatcctatcagaaagactgtggtttccacactccctccctgtccagccttggagaagatcgattcctggataagtccttttctaaatctgccctagagatgggcagtttgttcttaaggccatacagatggcttatttcctttgccatcagggctttccacagtgcccaggtttctcatgttgtaaatgtagtaatgcttcagtcacaggggaaaattatatcctcttgcttactcctgtgttcctggtatgcggagaatgagaatgaataagttaaataatggaaga

SEQ ID NO: 131553 - DNA, 483 bp, Homo sapiens
  Payload ID: 5673
  Gene Symbol: EXD1
  Gene Name: exonuclease 3'-5' domain containing 1
  ENST ID: ENST00000558396
  CDS Start-End: 319-483
gttgggccgggcgggcgtcgcctctgcggcgtgtgtccccggcgtcgcggacctttctccaggttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgatggaggacagtgaattcctagcttatgtgtttggatgcttaaagaagattatttgaagacggcttttggaatcaattagcatggaccccagcagtgactaccatttcctcagccagattttgtggaagagggtgaaactcacattggtctgtggtgtcttcgagggtgtgcttcagcatgttgaccctaataagattgttgtcctgaagaaagtggaactactagatgaagtggaacaaggctca

SEQ ID NO: 131554 - DNA, 5107 bp, Homo sapiens
  Payload ID: 5674
  Gene Symbol: EXD2
  Gene Name: exonuclease 3'-5' domain containing 2
  Uniprot ID: Q9NVH0
  ENST ID: ENST00000312994
  CDS Start-End: 322-2187
ccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaaggctcactggatgtaaatgtaaaacttcgcgactttataaaactggcattcctaggggaggggctatttatcctacaggtccctgcctcctggcagtgccatggtatgtgtgcatggatataccagacacagtcaccatcggccatcagtagcagcccatgaacccacgtgcacatcctgcatcttgctcttctgacccttcattcccacttgtcttcaggcaggcatttctgggatctaaactagaaatccttgaaaacaaatagtaccagccactttgaggaatgtgcattcactgtagtgggttattatggggtctctgcctcctggctgtgttatgcggagcccaggagtggaggagagccgtggaaatagacagggagaggctggtacttgggttgtggtaatagtcaggcttgccacaagagggcactcatagatttgtttttatattcattcttgagaaaaaagcaactggttactgaacgtaactcatgacttatgtttcaaattttgcatagctgattttaagtcattttgatagctttgcaagaaaaatttttcctttgaaacaagggagtagggctgtttcattttctttccttctaatcctcatgccaagaggtgagaaacacttaaggtcatttaaggtgctagggaaagggttttcccatggagctttctgtgaggcgcagtaaaatagagccagcagcaaagtagaggaaaaagccagactgcgtcacacaagatttctcatccttttcaggagagagtcactgtgtagatttgaatcttttttctttgagtctgctttgaactttagcaggcttttcctaagactgacaattgtcgtcttaaatcagagatttgagggtagacttattttatggcaaatgtctatttttctgatataaaagtaacaatgctcattacagaagaatctaaacaaagaataaaaattagccatcttctctccatctaaaacagagctaaactttgctgatatgtttatgaatttcctttcagtattaaaaagtgcatataaggtgtatatttacacaaaattgaaggtcatacatagatacaggttggtatcctaactttaccctctcactgattaacatggtatcacgagtaacttcctatgtttttaaatctttgaaaatagatttctagtggttctaccttatccatccccacactgttgaaaattttggttgtttcagatacttttattatcaatgatgatgtgataaagtttcttgtatatatctctttggctctatctttggtaatttcttaagaatggaatcttagaattggactgtgaagagggggattcacattgctggggctaagtacaaattgacatcaccttttaggaatgaaatgcttctctttgaccctttagctccagtgtcccagcatagtcactgggcttcataggagtagcagtgagaggacagtgtcacagcaagggcctctctgcatgctccctgatcattgtgtttgcaggttcagcatttcttcttgagtccttcccttcttccaaccttattgcctcatttcccccttgtagtcaatgttttttggaaacactgtttattttaaaataaaaatgtaaaaaaaaggtaaaaaaataaaattttaaattttaaaata

SEQ ID NO: 131555 - DNA, 2688 bp, Homo sapiens
  Payload ID: 5674
  Gene Symbol: EXD2
  Gene Name: exonuclease 3'-5' domain containing 2
  Uniprot ID: Q9NVH0
  ENST ID: ENST00000409949
  CDS Start-End: 781-2271
ccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttagg

SEQ ID NO: 131556 - DNA, 2828 bp, Homo sapiens
  Payload ID: 5674
  Gene Symbol: EXD2
  Gene Name: exonuclease 3'-5' domain containing 2
  Uniprot ID: Q9NVH0
  ENST ID: ENST00000409675
  CDS Start-End: 80-1570
gcccgctgcaggtgtgcggcccagtccgagacagcaggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaa

SEQ ID NO: 131557 - DNA, 2496 bp, Homo sapiens
  Payload ID: 5674
  Gene Symbol: EXD2
  Gene Name: exonuclease 3'-5' domain containing 2
  Uniprot ID: Q9NVH0
  ENST ID: ENST00000409242
  CDS Start-End: 657-2147
gcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgc

SEQ ID NO: 131558 - DNA, 3404 bp, Homo sapiens
  Payload ID: 5674
  Gene Symbol: EXD2
  Gene Name: exonuclease 3'-5' domain containing 2
  Uniprot ID: Q9NVH0
  ENST ID: ENST00000409014
  CDS Start-End: 658-2148
acaggttccaggtctttaacgtgagcccgctgcaggtgtgcggcccagtccgagacagcagatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggaacgtcatggtacctacctccagtggcttttctaaggattcaaatagatcacccccataaaggattcagcacagtgtgaacatatagtagtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcac

SEQ ID NO: 131559 - DNA, 3252 bp, Homo sapiens
  Payload ID: 5674
  Gene Symbol: EXD2
  Gene Name: exonuclease 3'-5' domain containing 2
  Uniprot ID: Q9NVH0
  ENST ID: ENST00000409018
  CDS Start-End: 129-1994
gggtgcgcgcaggcggccgcacaggttccaggtctttaacgtgagcccgctgcaggtgtgcggcccagtccgagacagcagattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccaggtaatttatgctgccagggatgcccagatttcagtggctctctttcttcatcttcttggataccctttctctaggaattcacctggagaaaaaaacgatgaccacagtagctggagaaaagtcttggaaaaatgccagggtgtggtcgacatcccatttcgaagcaaaggaatgagcagattgggagaagaggttaatggggaagcaacagaatctcagcagaagccaagaaataagaagtctaagatggatgggatggtgccaggcaaccaccaagggagagaccccagaaaacataaaagaaagcctctgggggtgggctattctgccagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcggaagaacgtgattccacatgagtaccggaagcacttccccatcgagatgaaggaccacaactcccacgatgtgctgctgctctgcacctcctgccatgccatttccaactactatgacaaccatctgaagcagcagctggccaaggagttccaggcccccatcggctctgaggagggcttgcgcctgctggaagatcctgagcgccggcaggtgcgttctggggccagggccctgctcaacgcggagagcctgcctactcagcgaaaggaggagctgctgcaagcactcagagagttttataacacagacgtggtcacagaggagatgcttcaagaggctgccagcctggagaccagaatctccaatgaaaactatgttcctcacgggctgaaggtggtgcagtgtcacagccagggtggcctgcgctccctcatgcagctggagagccgctggcgtcagcacttcctggactccatgcagcccaagcacctgccccagcagtggtcagtggaccacaaccatcagaagctgctccggaaattcggggaagatcttcccatccagctgtcttgatagctgctttcctcccagttaggacaagtgggaagctggagccaaggttgaagagtcacctcttcccattttagtacatcattaattgtcaaagcctgtgtgacacaactcagaatactaacctagactaatcccaggatgcttctgctggagcaaagatattgtttgaaggagagtttatggttttggattttaaacgggcagggtcttttttcctctcatttttgtggacaagagaggccttcgcctttatttttactctccctcttctgctgtccctgtgcagaggaaaaatgaagaattctcccagaagtgacttgtcaagacttaaaaaaaatgtttttaatgcatttcttccttgtctagtgcctcggtttatctctaacaggggctgtccagtatatcggtcctgttaggaggggagaaaaagttcttccaaaggctggagaagtgaacaaggagtcaaatttattttcccaattcaacttcataattatcatttctttggcttcatgctctcccgtaactcatgtggttgggatccatcccatctgggtcacttcagtctacttcacgtacttgaaaaggctttcctttacacttccaggaccaaacagcaacttcctgccacacacttccaccctatcactgggagaaatccttttctggacatgagcctttgacctgggtggggcagaaagaaccacaaactccatctcccaatagaactttgaaattcactcagcttttcctttcatgctgtttgttgcctgcttgttgcactcctcctgccccagaactgcaagatttttagcttcacccctttctgagagtaatgttatcttttatcagaatcagtatcagttcccctgtattctgtgcttcatcgaatttgcaagactgacctcttttaagcatttaattcactcccagagtcatctggtcaggttgcaatatgaggacttctctgtctcctctgaagcctgggacactgagcttacttaatacattagatgttcaaaagaggagcgttgtttcatctttcaaaatgttaggccattactttgagtataaaatcgacttattaatgattagtaatttttctaaagtattgggaaaactttcttattttataagatcttaacaagcttaaaaaagaattttatgaccagaatccaacaagagctctattttggaattgtgcccaagttggtgatgtttactctaaaattaataataaaactacttgtaagcacaa

SEQ ID NO: 131560 - DNA, 1143 bp, Homo sapiens
  Payload ID: 5674
  Gene Symbol: EXD2
  Gene Name: exonuclease 3'-5' domain containing 2
  ENST ID: ENST00000413191
  CDS Start-End: 802-1143
gcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctgttttctctcctggattcgtatgaggagactgtccttcctgtttcgcagatgaggaaactgaggcttagagaagtttggcaaattggctaagttcctacagctaattgtgggattagtgatatgcttttctaaagagtagaaaagtcgaagatgtctagacagaacttagtggctttgacagtgactacccttctgggtgtggctgtaggggggtttgtcctctggaaaggcatccagcgccgccgaaggagtaaaacgagtcctgtgacccaacagccacagcagaaagtgctgggcagtagagagctgccccctccagaagatgatcagctgcactccagtgcccccagatcctcgtggaaggaacggatccttaaagcaaaggtggtgacggtgtctcaggaggcagagtgggatcaaatcgagcccttgcttagaagtgaattagaagattttccagtacttggaattgactgtgagtgggaacgtcatggtacctacctccagtggcttttctaaggattcaaatagatcacccccataaaggattcagcacagtgtgaacatatagtagtaaatttggaaggcaaagccagccctctgtcacttctacaaatggcctccccaagtggcctgtgtgtcttggttcgcctgcccaagctaatctgtggaggaaaaacactaccaagaacgttattggatattttggcagatggcaccattttgaaagttggagtgggatgctcagaagatgccagcaagcttctgcaggattatggcctcgttgttagggggtgcctggacctccgatacctagccatgcggcagagaaacaatttgctctgtaatgggcttagcctgaagtccctcgctgagactgttttgaactttccccttgacaagtcccttctacttcgttgcagcaactgggatgctgagactctcacagaggaccag

SEQ ID NO: 131561 - DNA, 2872 bp, Homo sapiens
  Payload ID: 5675
  Gene Symbol: EXD3
  Gene Name: exonuclease 3'-5' domain containing 3
  Uniprot ID: Q8N9H8
  ENST ID: ENST00000340951
  CDS Start-End: 197-2827
acttccgccgggagctttgtgcgcccggcttcctcgccccgcccgcgctggccttggtgcgccggataaagccctccgggccagcggctgcggtcgggccaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagacggtaccctgaggtgacctccttgagcctggagaagctgagtccgaaggcgctgagcaggcaggtcttgcgtctgcaggagcggtacggcgtagccccagcgctgtgtcccaacgcggccattcagcagcgcctggcggccctgcggcacctgtgccacaagcggtttgtggagaagagcctgtcacaggagaactggaccgaccatgtgcagggcctggtggggcagagcccgtggcttcaggagcagctgtctcagctgctggtctcccacagtgacccagtcacggccgcccagtgtgccatggaactcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcgtgccagccccagccgtggacagggccagggagctgaggggcctgagcctcctggtgcagcaggtgctgggcacagccctggacaagacgcagcagctgtccaactgggaccggaggccgctctgcgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggtccctgtggctgtggctgtgtctgagggcgctgcccctcagattccggccagggccttccgtgtggtgtgtgacaacatgctgcaggggctggcacggagcctccgctgtctcggtgtggatgcacgcatgctgggcaatggtgaagaccaccgcagggcggccgaggttgccaggcaggaggggaggatcattctgacgtcggggcagccattccacaagctccgggcccaggtcggggctgggcgctgcctctcggtcgactgctccctgaaggcccagcagcaggccaaggctgtgctcaagcatttcaacgtgcgtgtcacccacgcagacatcttcagccgctgccaggcctgtaactgtgaccagtacctaaaggtctccagggacatgatgaagcagctcatgtggctcagcagtcaccaggaggggcccaggagctcaggtgacgaggccacccagagccaggcggtgcaggagccaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccgactgctgggccc

SEQ ID NO: 131562 - DNA, 962 bp, Homo sapiens
  Payload ID: 5675
  Gene Symbol: EXD3
  Gene Name: exonuclease 3'-5' domain containing 3
  Uniprot ID: Q8N9H8
  ENST ID: ENST00000479452
  CDS Start-End: 90-830
cgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagctgccatgtgactgcagctggagcagctgcctctggagaggagcggctggggctggcaggagcacagccctcttctcccgagtgaaaagagttaactgctcttagaagaacgaaaataattctccgtggtggctcttctcatgcaggcatggcaaccgtactgctttcttgttcatccattcctttgttctttcatctaataaagtttttggaagca

SEQ ID NO: 131563 - DNA, 1585 bp, Homo sapiens
  Payload ID: 5675
  Gene Symbol: EXD3
  Gene Name: exonuclease 3'-5' domain containing 3
  ENST ID: ENST00000465160
  CDS Start-End: 97-267
aaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggcacccacaggcttctacagcctcttctccacctaagcagagtgggatgttttcaaagtgcaacaccccagctagcagggcccctggaacagcctcggcgccccctggaacactaatggccctccctggaacagacacggcacccccaccgagaacagcctcggtgccccctggaacagcctcagcaccccctggaacactaatggccctccctggaacagacacggcacccccaccgagaacagcctcggtgccccctggaacagcctcagcaccccctggaacactaatggccctccctggaacagatacggccccccgccagaacagacatggtgcccgctggaacactaatggtcctccctggaacagcctcggtgccccctggaacactaatggccctccctggaacagacacggcgcccccccacagaacagcctcgatgccccctggaacagcctcggtgccccctggaacagcctcggtgccccctggaacagcctggtgctcctggaacagacacagcccccccagaacagacacagcaccccctggaacagcctggcgcttcctggaatggccacatccccccatcctttctgtgctgctttaggcatctgcccttacatggttcgtgtccagctctgtcaacaaggccagctccacaagaggccccagctcagccctccccagtgggctcccctactcaggctctgggtcagcttcttcccaggaggtgtcctggcccctgtgctggccccgcctcgctgcctggacacctgtccgtgccaccctggtcactgagcaggacatccgcgtctgtggcccctgggaccctgcccccgacagccaggcctgggtttgtccttttaggtagagtgcctggtccaggtcattggaggagagtccacatggccacctctggcgtgttctagagaggccctcccgcgctgggtcaggaggcatcatcgggacaggagaagggggctgagctcctgttcctctctccctcccccgaggccaagaaacattcccatccgaatgtccactgcgctcacagattcctttcctcctaaaacttcagccttggccaggctcacggccaggattatggtggctcacgcctgtaatcccagtactgtgggaggccgaggcaggaggatcacgaggtcagaagatcgagaccatcctggccaacatggtgaaaccccgtctctactaaaaatacaaaaattagctggacatggtggcgggcgcctgtattcccagctactggggaggctgaggcaggagaatggcttggaggcagtagaactgcttgaaccctggaggcggaggttacagttatccgaggttgtgtcattgcactccagcctggggaacagagcgagactccatctcaaaaaaaataaaaaacttcagcttttgcatga

SEQ ID NO: 131564 - DNA, 2932 bp, Homo sapiens
  Payload ID: 5675
  Gene Symbol: EXD3
  Gene Name: exonuclease 3'-5' domain containing 3
  ENST ID: ENST00000478344
  CDS Start-End: 1-110
tcatggattcctggtgccagcccggctttgacatcaaggacgttgccagtttttggaagcacttggtgtgtgacgtctgtcagcaattacagagaaaaggcagcacctgacaaggagcccatatggtgcctgtatggattcagggaagccatgtgcatgtgtgtgcatgtgtgtgcatgtatgtgtgtgcccatgtgcatgtgtgcctgcaggtgtgcatgtgtgtgtctctgtgtgtgcacgtgatatgtgcgtgtgtgcacgtttgtgtgtgcctgtaggtgtgcatgtgtgtgcatgtatgtgtgtgcctgcaggtgtgtgtgtgtgcatgtatatctgtgtgtgcattgtgttcgtttgtgcaggtgtgtatgtctgcgtgcatatgatgtgtacatgtgtgtgcctgcaggtgtacgtgtgttttcgtgcatgtggtgtgtgtgtgcatgtatgtgtgtgcctgtaggtgtgtgtttgtatgtgtgtgtgcatgggtgtgtacgtgtgtgcatgtgtgcctgtgcatgtgtgtgcgtgtggtgtgtgtacatgtatgtgtgtgcacgtgtgtgtgcctgcaggtgtgcgtgtgtgtgcatgtgtgtgcgtgtgtacctgtgtgtgcactgtgttcatgtttgtgcaggtctgtgtgtgcatgcatgtgtgtgtacgtgtgtgtgcctgcaggtgtgcatgtgtgtgtgtgtgagatatgagggatgacatctgggaggggaggggcttcctgctctatatctggtcaaggtgccccgagagtgaagcaagctgaaaggtctgtgaaggctccagggcccatccactggcaggcagatcccggcctccattccccacacagccccagggttgtctcactggagagtcacaggcttggacttggacgtcaggccgtcccgggcccatcctcctccacttgtcctccaagtcacttccactttctgagtttgtttcctcattcgcacaatggggctgagtccacctgactcaaagcttgctaagacttttcatcagagggagcaggcagcagccgcacagcgtcaggccaggcacagacggtaccctgaggtgacctccttgagcctggagaagctgagtccgaaggcgctgagcaggcaggtcttgcgtctgcaggagcggtacggcgtagccccagaagagcctgtcacaggagaactggaccgaccatgtgcagggcctggtggggcagagcccgtggcttcaggagcagctgtctcagctgctggtctcccacagtgacccagtcacggccgcccagtgtgccatggaactcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcgtgccagccccagccgtggacagggccagggagctgaggggcctgagcctcctggtgcagcaggtgctgggcacagccctggacaagacgcagcagctgtccaactgggaccggaggccgctctgcgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggtccctgtggctgtggctgtgtctgagggcgctgcccctcagattccggccagggccttccgtgtggtgtgtgacaacatgctgcaggggctggcacggagcctccgctgtctcggtgtggatgcacgcatgctgggcaatggtgaagaccaccgcagggcggccgaggtcttctgttccaagctcttagtgaattctgtatttttaggacttgctctacaaatagtacagctttattttcaccctcatttgttttctgcagcttcaaggattgtctgtttatgtcggtctaggatgttctagacaggtgttcacatttgtgaccaccttactcacaggtgcagtgatctcacagaggcagacatagattcatgcattttctggagagaacatttttgaagaagggaagctttgaagcacagattctgacataacaagtatttgctacttccaagcactgcagtcaaactaatggatataatgggatgggctggttgctcctaactgtgctggagaaggtgggaaagaaaaagatgagctcagctccacacgaaggacctgcaagcttctatcttggcccagaagaagcccttattccctgtagctgcagaagtaaaattgctgaacaccatgcctagagtttaatcctgtgagcagctgaattacaacagaaattaaattcacaactgatgttattaaactttgtccacttggccagtcctatccatgtaaaattacatttcattgtctttg

SEQ ID NO: 131565 - DNA, 2176 bp, Homo sapiens
  Payload ID: 5675
  Gene Symbol: EXD3
  Gene Name: exonuclease 3'-5' domain containing 3
  ENST ID: ENST00000491734
  CDS Start-End: 1-423
atgagcatcccactgctcctccaggacaaggtggccctcgtggagcgctatgtggccggcttcccggacctccagaggaggctgctggtcctcatggattcctggtgccagcccggctttgacatcaaggacgttgccagacggtaccctgaggtgacctccttgagcctggagaagctgagtccgaaggcgctgagcaggcaggtcttgcgtctgcaggagcggtacggcgtagccccagcgctgtgtcccaacgcggccattcagcagcgcctggcggccctgcggcacctgtgccacaagcggtttgtggaggttcgtgagcaggagggggtcctgggggcagccagccgcggcctgagccacagagtttggcctgggatactcactgcgcactgcagggtgcacagacatatcaagtaggagctgcttcttgccccagagctggaagagcctgtcacaggagaactggaccgaccatgtgcagggcctggtggggcagagcccgtggcttcaggagcagctgtctcagctgctggtctcccacagtgacccagtcacggccgcccagtgtgccatggaactcttgctgcccgaggagcggctgccggctgcggtggctgtggaactccgccggttcaggctccaggggagggcgactgaggctgactcgaggctggaggtgaaggacatgaaggaccgttactaccagctgcccatccccagggagaacgtccacctcctggcctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagcccaggccttttcccggctggtggcccagctcctctcggacccctctatcaccaagctgggctacgggatggtgggggacctgcaaaaactgggcacgtcctgccccgccctggcccatgtggagaagcagattctgggcggcatggacctgctgctggtgcacagacagatgcgggtggcgagcgtgccagccccagccgtggacagggccagggagctgaggggcctgagcctcctggtgcagcaggtgctgggcacagccctggacaagacgcagcagctgtccaactgggaccggaggccgctctgcgaggagcaggtcatctacgcagctgccgacgcctactgcctgctggaggtgcaccaagccctgtgcagagagcccgcccgcttccacctgtcggaggacctggctgggagccggaggcccaggcacagagagagaccaggggcacggaagccacccggcctgcagaaagcgtcagcaccggccgcacccaggcaggggctggcacggagcctccgctgtctcggtgtggatgcacgcatgctgggcaatggtgaagaccaccgcagggcggccgaggttgccaggcaggaggggaggatcattctgacgtcggggcagccattccacaagctccgggcccaggtcggggctgggcgctgcctctcggtcgactgctccctgaaggcccagcagcaggccaaggctgtgctcaagcatttcaacgtgcgtgtcacccacgcagacatcttcagccgctgccaggcctgtaactgtgaccagtacctaaaggtctccagggacatgatgaagcagctcatgtggctcagcagtcaccaggaggggcccaggagctcaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccgactgctgggcccatggccgtg

SEQ ID NO: 131566 - DNA, 1432 bp, Homo sapiens
  Payload ID: 5675
  Gene Symbol: EXD3
  Gene Name: exonuclease 3'-5' domain containing 3
  ENST ID: ENST00000460390
  CDS Start-End: 146-268
ccttggtgcgccggataaagccctccgggccagcggctgcggtcgggccaaggttccgcgccgggcgtggacggtgtggggcggtcccggccccgcagatcctcgttcctagctgcctgccagcgtcctcggcccggccctgaggatggacccaggagatcccgctggtgaccctgccgctggcgagcgccaccgcatgggccgggaccccctcctgctcctgcaggccctgcagaccctgtggtccacgcgggagcggaagcagtagagacggagtttcaccatgttggccaggctgttctcgaactcctgacctcagagacggagttccgctatgttgcacagacttgtcttgaactcctgagctcaagccatcggcctgcctcgtcttctcaaagtgctgggattccgggcgtggccactgcgcctggctgatgcgttgttcctgcatttgcccaccgactctctgtgtttggctgtaaccacgttgcacgctcagtcagtcgcttgctgctcacagagtccagagtcccgagggacagagaagctgcctttcaccctgtctggccactttccccgaggggcatcctttggagggtctggactttgcagccttgcctcccgcgcctttgggcatggcaccctcctggacagcgctgaggtctcctcacacactcatctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagctgccatgtgactgcagctggagcagctgcctctggagaggagcggctggggctggcaggagcacagccctcttctcccgagtgaaaagagttaactgctcttagaagaacgaaaataattctccgtggtggctcttctcatgcaggcatggcaaccgtactgctttcttgttcatccattcctttgttctttcatctaataaagtttttggaagca

SEQ ID NO: 131567 - DNA, 2217 bp, Homo sapiens
  Payload ID: 5676
  Gene Symbol: EXO5
  Gene Name: exonuclease 5
  Uniprot ID: Q9H790
  ENST ID: ENST00000296380
  CDS Start-End: 206-1327
ttttttgcgagtggcgggccgactgtgtagtccgctccggcagcgcgctctgcccggcttcctcagtctcctcgccgggagcgtccgggagcagctccgaggccgcggcgaaaccagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccaggacagttgaactgatggttttttcataactgcagtccttcaaagatgaccaccatatatagttgtgtacgtgttattccaagcctttaaatatatacataaacatattttggaatcagaatgagcagaccaaaacataaacaataaatattctcaaagagacaagggaagatgaagtagaaacaggaagtcataaatattagatacgaaaaacataatacatggctgggtgcggtggcacatgcctgtaatcccagcactttgggaagctgagatgggtggatcacctgagctcaggagttcaagagcaacctgaccaatacggtgaaagcccgtctctactaaaaatacaaaaattagcctggggtggtggcgtgcgcctgtagtcccagctacttgggaggctgagagaggagaatagcttgaacctgagaggcagaggttacagtgagctgagatcatgccactgcactccagcctgggcaacagagtgagactctgtcttaaaaaaaaaaaaaaaa

SEQ ID NO: 131568 - DNA, 1892 bp, Homo sapiens
  Payload ID: 5676
  Gene Symbol: EXO5
  Gene Name: exonuclease 5
  Uniprot ID: Q9H790
  ENST ID: ENST00000358527
  CDS Start-End: 401-1522
gggactgggctctgggcggcttttttgcgagtggcgggccgactgtgtagtccgctccggcagcgcgctctgcccggcttcctcagtctcctcgccgggagcgtccgggagcagctccgaggccgcggcgaaaccagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccag

SEQ ID NO: 131569 - DNA, 2567 bp, Homo sapiens
  Payload ID: 5676
  Gene Symbol: EXO5
  Gene Name: exonuclease 5
  Uniprot ID: Q9H790
  ENST ID: ENST00000372703
  CDS Start-End: 1075-2196
gggctctgggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagaggttaggggaaggccggagaatgggctgggaggctgcgtttcggagcttagggttctgtccctgcgatcgccgcgtctccctcccttggtgggcgcggctcccgggaagcggctcgtctcgtctcccctcacaggccgggttcccgttctggaccttcgccctcggaacacagtgctgttggccgggactccttcccgaggtggacggctccctgttcttattcctggctctgccagaactgtaggaagtgctcagtacactttagggcatgcatggcactccctgggagacagtgctttagggccagaggaaagatcttccctgaaggcaaacgcccgcggagcccacaagtccgggccgcactgaacaagtcaggatgttgccatcggcaattctgcagaaggcagtaacccatctgagagaaagagccgctgtcataaggtctcttgcttgagctgctgggttgagaatggagctggaagagggaactgatctcggagctccttggggatcttggttatgtctgacccttttactttcagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcaggtaagaaaggaccagaagttccggttctaccatagcaaggacctaagttgctaatttaggttctttaatgcagacctggtctttcagaacttctttctcttccctagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggttcttttttttatttccacaacctctaaccacattcagtccaggaccaaggctcagggatgagtgggagagatgggttatactgtccctggagcttcatcatgattgcctgagaagacagatgctcatcatggctggaatgaaggtatccttcagtaaactttgctttcctaagaaaattcttcagtttctgataagtcatccctatttttatcttgatcaaggctttctacagttacataataaaatgaaatgctgtccagg

SEQ ID NO: 131570 - DNA, 805 bp, Homo sapiens
  Payload ID: 5676
  Gene Symbol: EXO5
  Gene Name: exonuclease 5
  ENST ID: ENST00000418186
  CDS Start-End: 134-805
cgggccgactgtgtagtccgctccggcagcgcgctctgcccggcttcctcagtctcctcgccgggagcgtccgggagcagctccgaggccgcggcgaaaccagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatc

SEQ ID NO: 131571 - DNA, 856 bp, Homo sapiens
  Payload ID: 5676
  Gene Symbol: EXO5
  Gene Name: exonuclease 5
  ENST ID: ENST00000419161
  CDS Start-End: 115-856
cgctctgcccggcttcctcagtctcctcgccgggagcgtccgggagcagctccgaggccgcggcgaaaccaggtggagtccgagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaa

SEQ ID NO: 131572 - DNA, 863 bp, Homo sapiens
  Payload ID: 5676
  Gene Symbol: EXO5
  Gene Name: exonuclease 5
  ENST ID: ENST00000420209
  CDS Start-End: 186-863
gggcggcttttttgcgagtggcgggccgactgtgtagtccgctccggcagcgcgctctgcccggcttcctcagtctcctcgccgggagcgtccgggagcagctccgaggccgcggcgaaaccaggtggagtccgaggttcggaggagtatcagagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgat

SEQ ID NO: 131573 - DNA, 941 bp, Homo sapiens
  Payload ID: 5676
  Gene Symbol: EXO5
  Gene Name: exonuclease 5
  ENST ID: ENST00000443729
  CDS Start-End: 200-941
cggcagcgcgctctgcccggcttcctcagtctcctcgccgggagcgtccgggagcagctccgaggccgcggcgaaaccaggtggagtccgaggttcggaggagtatcagagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaaggggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaa

SEQ ID NO: 131574 - DNA, 865 bp, Homo sapiens
  Payload ID: 5676
  Gene Symbol: EXO5
  Gene Name: exonuclease 5
  ENST ID: ENST00000415550
  CDS Start-End: 383-865
gtccgctccggcagcgcgctctgcccggcttcctcagtctcctcgccgggagcgtccgggagcagctccgaggccgcggcgaaaccaggtggagtccgaggttcggaggagtatcagagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaaggg

SEQ ID NO: 131575 - DNA, 688 bp, Homo sapiens
  Payload ID: 5676
  Gene Symbol: EXO5
  Gene Name: exonuclease 5
  ENST ID: ENST00000432259
  CDS Start-End: 387-688
gcgagtggcgggccgactgtgtagtccgctccggcagcgcgctctgcccggcttcctcagtctcctcgccgggagcgtccgggagcagctccgaggccgcggcgaaaccaggtggagtccgagggagcagggattggatcaagtcattgcatctagagtacgggggaacgaagaaatcatggagagagtttgccccaggagagaggcgagcgttatgtaacctaggatctggggtgggtaacagtctgtgcagtgtcaatgtgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaagga

SEQ ID NO: 131576 - DNA, 10187 bp, Homo sapiens
  Payload ID: 5677
  Gene Symbol: EXPH5
  Gene Name: exophilin 5
  Uniprot ID: Q8NEV8
  ENST ID: ENST00000265843
  CDS Start-End: 112-6081
attattggctgtgggatcaagttcgtgaaactggtcttgtacaggttgaaaaatgccttcctaacaggaggcgccaaggagcttaagtgtaactcacacacagtaaagaaaatgacgaaagttcctccggcgtttgatttcagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaaggaaaaaaaaaagataaaggaattttgtaagtacttcctgttatatccgtagtggagcctgggaggcacatggtcaaagcacatgttgaggttatagattaggacctgaatccctagtaagccaatagaaggttagcagtcctagaaattcctctgaaaccgtgggggactggctggattattaagggcttttagtcaagccaaggacttaggccaggcaacctgaccatacagaaagttgcctggtcacagaatttctgcttatgaagagaacatagctgaggagcagaggtaggaagtaggtatcccttcatgggaccgacttacctttactgcagttctctcagcaactggcttttcccatttcctcagaactatccattttcacattttcttttttttgtttttgttttttgtttggttttgttttgtttttgttttttggagacggagttttgctctgtcacccaggctggagtgcagtggcatgatctgggctcactgcaacctccgcctcccgggttcaagcgattctcctgcctcagcctccagagtagctgggatcacaggcgcacccaggcgcacgctgccacgcccagctaatatttttgtattttagtagagacggggtttcaccgtgttgcccaggctggtctcgaactcctgagctcaggcaatccgcccacttcagcctcccagagtgctaggattacaggcatgagctaccatgcccagtctttttttgttttgttttgtttttgtttttgttttgaggtggagtcttgttcttgttgctcaggctagagtgcaatggcatgatctcagcttactgcaacctcctcctcccaagttcaggcaattctcctgcctcagcctcccaagtagctgggactacaggcacccaccaccacacctggctaatttttttttttttttttttttttttggtatttttagtagagttggagtttcaccaggttggccaggctggtctcaaacttctgacctcaggtgatctgcccacctcggcctcccaaactgctgggattacaggcatgagccaccgtgcctggcccacattttctttaattgcaaggtagaacgcttcttttcaggtggggcattttagtcccaaatatcaagtgggaaccttggccaagtccctaaaatgccatcaagtcagatctgacaccctggaattcattctttgctgcaggatcatctacgaaacccttgggaaattctaaggcagagctcctaagggcttgtcactatgattcagtgatttatctagagtaaatcacttatgatacccactgatattttggctttcctaactctttatttgccatgcagaacctcgggggatttctctcctaattcaggataaagaccaatagatggcagtgaagataatctgctttaactacagacagcatggattcctggatctcaatactatgatagtcaacatgagtggattttatcttgcttggtttatatttgcttcgcgacctaatctaattttccattttttatacctagtctgtttcatcattataaactaagaataatgatagatgttggtgaagtgtatagagatctggaactgatagagagttaagaaagaactatgttgttgttatccttctaatcattcccttacatagacgcaaaatgcgtgggttactttacatggttcccatgcaactcaaagctaatgaacatgcggtaactaacatgaaagctattccctaaatctgtcaactattttaaacttcaagctctgaccaatcctgagctcagaaagctcaaaaatcaaatattgtgaacttttcaatgcaaatttgtatggtaaagaataaataacactatttcttggttaatatatgtttgtaaattctgcctttcctctttttctatttatctgattattattattattattattattttctttgagacagagtctcactctgttgcccaggctggagtgcaatggcgcaatctcggctcactgcaacctccgcctcccaggttcaagcgattctcctgcctcagcttcccgagtagctgggattacaggtgcccaccaccacgcccagctaatttttgtatttttagcagagacggggtttcgccatgttggccaggctggtttcgaactcctgacctcaggtgatccgcctgcctcagcctcccaaactgctgggattataggcatgagccacctcgccagccctatttatctgattatttaagtaaaactttaataaaccatgacctacattttctatgcaattttaagatactcagagttaatattttaatattgaggttcttgatttttttaatgatcagctttcaaattatatttcagtatatactctgagtctacgtgtatgctacaaaaggtgaaatgaagttagcttatttttcagtgagtttaggctatattaagagttaggtaagttaggtaagggtgaaactgctttggggcccagactgcgctggaatgtactgtttaaattcaaaggtaattgatggccagtgttcagttgctctatttgtaacgtttgcatgttggtctggctgaagtatcaggaaaacacaaaattcatgaaaatagcaccttttataattttatacttttataaagcacttgttaaagaagtatagcaaatttctatgtattttaacatacaagtcgctgcattttaatgttcatttttggtatagctatggtaacttataatagtcatttttatattcataacttgttttctgaaagatatagtcattattaaaataaacattcatgtaaatggagtaaatcataggggaatcaatcgtaataaataccttataaattataaacttgtttagatactagatttctataaccataaattttatactgtaaagtctgtttaaaatagggtttaatgaagttattttaatttttagagactcccctctaaataatttactcctacattgtaaatacattgatgccaacaaaattccaactgctactaacaaaggtttggttggtgataagctaataacagctactttgtgtaggaggtaaatatgtgtactggagggggtaaaaatccatttaggttatggcaaagatgggaatcaaactgtaaaactcatagccccataaaattaatattctttgttaagtgccagagggtttaagagaacttcttgcttagagtttattgataataataatgcttcagaatatcccatttaaatgtacagtgtaaatatgtaaaatattttacttcccaggcaagtttgtggctgtattgccacttagtggctctttgtgactggcagttctgtatatctgaaacaaataagctgtaagcacttttgttaaaactttgtcaaataatccttttatgtacttgttctcagacctgttctctggttatgaaatgtgttaaagacaaggtgcaaatttaaaacaatgcctgtattgaaataaatgacttaaacagatgca

SEQ ID NO: 131577 - DNA, 6542 bp, Homo sapiens
  Payload ID: 5677
  Gene Symbol: EXPH5
  Gene Name: exophilin 5
  Uniprot ID: Q8NEV8
  ENST ID: ENST00000525344
  CDS Start-End: 6-5954
gaaacatgtcattaagtttcttaaatgacgaagaggccaggaagatccttcaggtgctggaaaggaatgaggagttacagagggccgagaaggacaggatcagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaagccatcctccaaaagtcagggagcgccatttttctgaaagcacttctattgacaatgccctgagtcgactgacccttgggaatgaattctctgtcaacaatgggtacagtcgaagattcagatctttttctgaactcccctcctgtgatggaaatgaaagttgggcttatcgcagcgggacaaaaacaggtcccaggtctgcaatatctatatacagacctatcgactatgggatctttgggaaagaacaacagttagctttcttagaaaatgtaaagaggtcacttacacaaggaagattatggaaaccaagttttcttaagaaccctggcttcctaaaagatgatttgaggaaccctcccaacccctcagagtcattaagctcaaattctcccagtagtcaggtgccagaagatggcttatctccaagtgaaccgcttaatatctatgaggatgacccagtggactcagattgtgacacagacacaaccacagatgatgaatactacctggatgaaaatgacaaagagtcagaactgtgaggctttttcaataaaatgctttacttttttcaccaaaagcttataatggaactaaggtgtacatgtgcatgtgcatggaaggataaaagatctagtctgggcagtgtctgctctgaaatgtcccacatctccttttttttcctccacaccctatatagacacttcctgaatgctagaacaatgaattcttgttttgagagagtctctgctattttctatctctgtaaatgttcttagcctgcctttccaccactcccacttaatccctgattcactgtctgatttgggctttctgctttacttccctcctaacatttttcatctttaattgtgatttacaaccctaatatcccaggcacatacaaaacttatgaattacccagcacaactgtgaaactctgtattgcttcttccggtccacaccctatactcatgacattaaataaaaggtagggatgataacagtggggtaaatattatcatcctgtttgactcatgaacatttaggaagtttaaggtggtgatcttctctttcaaacaaagataaaggaatttattttttaacctgagaaactgattgcaaaaagg

SEQ ID NO: 131578 - DNA, 5495 bp, Homo sapiens
  Payload ID: 5677
  Gene Symbol: EXPH5
  Gene Name: exophilin 5
  ENST ID: ENST00000526312
  CDS Start-End: 296-5495
gataaagctactggtgcagccactgaaccacagggctttctcttccttcactctgcctctttctgattgggaacacacaacagttgttttaaagctttccctggagggtgagtgataagaaacctattacctggaagtatcgcctttctaaagtaggagaacaaaaggccacactttccccagatgcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaaaacaagaaggaaagaggcaaaaagttgcaaagtgaaaccctgcatacttcattgatgcttcagagaaaaaatgtatccgaagaaaaatctgaaaattgtcaacaatccattaattcaagtaacagtggtccctctagtcttccagctctttcagaagttaatattggaaattcccaaactagaagaagttcttgggagtgtacagggagtggtagagccattccatttactggaagtggcaagtgtccccagaaagatcacacatccacagctgtaggtgatggctccagtggatcacagcctagggaaggcagaggggacattggaaccaactgccaaaaaatgactaataaaacactttctcactcagagagtcaagtctttgcccttactccagcattgcataaactacagcttggtgaggagactcagtcagatgaaccaaacttagagagtctgcagtctgaaccaagagaattacctcaaagaagtcaggaggcaaatatgacagagagcaggaaggctgaagatgaaatgcagaagtcagcttgggatcaaccttcacttcctgaaggaaacaaaaataaaaccaacttggatgacctagtaaagggggaaaatagatcttcagttaaacacagattggcagccatgtctaaagccagcagaaaattcccagctaaagatgtaagccccagaagacatgtagctactatcttcccccaaagtggaagcagatctggctttgaccatttatctcttggcacagtggagtgcaacccactgttccctgagcctactccaaaatctgcagagtccattggcgaaagcaggttgagtgagaacggaaagcatgtgaagaaatccgagaaccttctccccattactgtactacccaacagagaaccttctacacacgtcagcaaccagaagtctaacagcatttcacaacgacatcagaatgagtttaaaaacgtctcagaatcaccatcaaagcatgagaattctaaagacgtcacagcagctcagaatttagtaagagaatcaggagccccatcacccatcacattcaccagcctcagggaagcagaattctctgacaatcagaggaggctgagccctccttttccactggagcctgcacagaaatctagagtaagcagtccactggccagttttctgcagcaacaaaggagtgcttcatctctggagtgggaacctgagccacacctctatcgttcaaagagtttaaaaagcattaatgttcatggcgatctactacgaaaaa

SEQ ID NO: 131579 - DNA, 555 bp, Homo sapiens
  Payload ID: 5677
  Gene Symbol: EXPH5
  Gene Name: exophilin 5
  ENST ID: ENST00000531386
  CDS Start-End: 319-555
agtaacaagctggctttcaccggcaccctcccctttggtacggggtcagcagaagggtgttttgtcttcagcgagtcggaaaccccctgtcttcagtgtattctgcccaccaggatagggcactgtggattttggttttgaagcttgtccagagtcactcaagagagacaaagcggccattctactgtgtgctacccaacacccaccagcaaacttcagaagacaaagagggatatcagatggcttcagggagtgactggtgaatggtttgaagaaattcaaagaaaaaagttttgcaatgaaacagatgttagccaaatgttaaaacaaccacttacatacaggctaagtaaggagatggcaaaaaatgatccgatagaattacctacatcaagatctaaaaatgtaactaatcaaaaaaagccgacacctttttcttcccggatgagcttcagatcgtcatttgcttccctgttctcattcaggaaatctggaaaggagacttcaaagcttccatcactgggacagaaaggatgtgatggccatgcaggacct

SEQ ID NO: 131580 - DNA, 3893 bp, Homo sapiens
  Payload ID: 5677
  Gene Symbol: EXPH5
  Gene Name: exophilin 5
  ENST ID: ENST00000533052
  CDS Start-End: 318-3893
aaataaaaggtgttggaggtcactgtcgctgagaaacaagaggcagcaagcagctggtgggttgtgtgatgaggctgctggatttaacagaccactgtcctcccctcttgggtgaatggagggtttttcacttccagctttcacccgaggctgtttttgtctgatgaaagaaagagcagaccacaatgtagatttatgtgactgtagctaccagagtcactagcaaggaaatactcttcaaatagcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgagaaagacttaaatgaatctatttcagaagaagacaaacagctaagcaagatggaccagacaaacaaggcaggtgaaataccccaacctgtttcacagacagggatctcaaactctttacctgattttcaaaatcccttatcccaggactcagccaagagcaacgggtttggttttaatgcatctaccataataagttcaaaaaagtcacccagagtcttttccaggaaagatacctccaaaatgtatataccgcacacagataaatccaatgacattaaacaagataagaggtttactgaaaacagaaaacttggctcaacagcttcccttcctttcattcaggaacacagaacaccaccatctttccccaggacagaccaaggttgtcaccaggaattaactgtaaataatgaagatatttcaagaattattacaaataaccactggagctctgcactgactgatactcaaaatgcacaatactcaaaatgcaagttaactcctggccacaagacctcgtgtgattctttagatctgtcatcagctgcactaccagattcctcaccatcaaagaattcttcccttgatgctcctgtggttccatctactacagtgttctccaggagaagtccttcagacaaagatccatcgctaggagaaagagaagaaaaagacaatgctgggaagaaccaaaagaatcagtttattgtaagccactcagaaaaccaagagagaaatgatagtcctgtgcctacacatgatgaagtggttgatgtcaaatgccattcacactctccttttaggaatgaaagaggaaaaggaaaaataaggcatcatatatcctgtattgaaaagttaagcaaaacagaaagtatatcagtacccaccagtgatcacaggagcctcattgaagcaaatcaaagcaattccaaagtttctgaacttgacacaatttattgtaccttgccaagaaaatcaagcagttttctcatacatggcaggcagtcaggaagtaaaataatggctgcttcattgaggaatgggccacctcccttccaaatcaaaaataatgtggaagatgcaatggggaactatatgttaaacaaatttagtcccagttctcctgagtcagcgaatgaatgttccaaagtcctttcagactcagccctggaagcacctgaagccacagagagaatgacaaatgtaaaaagcagtggatctacttccgttagaaaaggaccacttccattcctcatcaacagggctatgtcatgtccctcaggggagccacatgcctcaactggaagagaaggaagaaaaaagccattgacctcaggcatggatgcttctgagctaacaccaagggcttgggagagaatcattagccctgtggaaagtgactcatctgttagagattgttctttaaccaaaagacaacaccaaaaggaaaacttccaagaatacactgagaaagagggtaaaatggctgcctccaggagaagtgtatttgctctttcaaatgaagaccctttacctttttgctcagacttgtcaggaaaagaacgtgggaaaacattacataaagttaagacgactagtacgttttctgtttctggtgatgaagataatgtaaaatgtctggaggtggtctcaatatattacactctaccgaggaaacccagcaaaaaattctgtaacctccttcaacagtatacacaaaatactaatttacttatagaatcacctcaagtggagactgaaacatttcctaacgctttagaaaaagacaaacagaattattctacacgagagcagtcaggaacaccttcatgtgaaaatctaaagatgtccgtcaactctgatcagacgctcaccactgaaaatatgactgccttccgattatcaaatagggggcccctagctcctacattacaggaaatggcttctgttgaggcagctgtttctcttcctgaagaggaatctaaagctagagagattttttcagataatttagctaaaacacctctaggtgattcagaa

SEQ ID NO: 131581 - DNA, 1882 bp, Homo sapiens
  Payload ID: 5677
  Gene Symbol: EXPH5
  Gene Name: exophilin 5
  ENST ID: ENST00000524840
  CDS Start-End: 251-1882
cactgtcgctgagaaacaagaggcagcaagcagctggtgggttgtgtgatgaggctgctggatttaacagaccactgtcctcccctcttgggtgaatggagggtttttcacttccagctttcacccgaggctgtttttgtctgatgaaagaaagagcagaccacaatgtagatttatgtgactgtagctaccagagtcactagcaaggaaatactcttcaaatagatgtgatggccatgcaggacctcctatgcctgtgaggggagctgctgtgcaggcaaaaatatacaattcacctctggaaaatcatctagttgacagtacatttgtcccaaagccagcagtcatgagggaggagagtggcatgcctccaccgtgggatgcttcactgctggagaatgagtttttccaagttttagatgacttggatagcaaattggctcaggaacagtctgcaagctcagtgaataccagaacacccctcaactatggatcaagaacacagttcggtcacttttattccagtggtaacagacatggtaatatcacagaaaggcacaaaaaacactataatgaaacttccaatatgtctatctatgacatcctaagaccaggaactcctagggaaggttttaaaaccttttctcctaggacaagcacaatttatgatatgtataggacaagggagcccagagtctttaaagaagattatgtgcaaaagaatacttttggcagtacttcgctgtgttttgacagcaggcaacggtcggccttaccagccacagggcatttcacagcaagaagcttacattttccagccacaactcagagcaagagtgggtttataccaccaaggcaccagcagagtccaaagagaactcctttatcatccatcatatggaacagatcagattcctctagagacagggagaaccaggaagagttcctgagggcaccatcaccaatggaaattgatcccgctgacaagtatgtgtatcccaggggttttcaggagaataagagatatgaatcgtaccattcacagaatgtttaccaacgtgttagtttaaatgctcccatggagaatgcaatgagtcccgacacttttgagaactcagagaacatgccattctaccatcaaagcaacacatttaccagatctttcttcagcaatacctttggacgaagcggagaacagaggagatttggacaaggtcctttttggggccaagagaaaggacattctttctggtctgactttcatcgaagcaggaaatcattcagttcttctgacagagactttgaaatgatttccatggaagcaaatagtgtatcagccattcatggccataatgtttcttctgaacactgggaatcattttcttctggttatggaacagatgtttccagaggccaagaagagccacatccttggcagtttgattttcagagatccacactggatagcatggtggtatcacatggtaatgagacccagttgactcctcattttggcacaccaaatgtttgctccatgactggttcaagctatcacgtcaaatctagtgagttggtaagtcaacaggacagttctcctgtagaagtacatataaacaaagaagcttcctcatttggaattgctcagactctagcatcctcattcaaaacttccttttcccagatttctgatgacagaaggaatcctcagagtcccaacttgcagaatcccacagtcactttgcagaaaatttttccaaataagcctgcctctcatccaatgagaagccatacagaagtcactgtgaccagcagcaattcagttgactctctgcctcttgccaaaagccagcccaatatcttggtcacagaagtaaataatgag

SEQ ID NO: 131582 - DNA, 4615 bp, Homo sapiens
  Payload ID: 5678
  Gene Symbol: ERI1
  Gene Name: exoribonuclease 1
  Uniprot ID: Q8IV48
  ENST ID: ENST00000250263
  CDS Start-End: 261-1310
cctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagaagacacgtttcagcagtatgtaagaccagagattaacacacagctgtctgatttctgcatcagtctaactggaattactcaggatcaggtagacagagctgataccttccctcaggtactaaaaaaagtaattgactggatgaaattgaaggaattaggaacaaagtataaatactcacttttaacagatggttcttgggatatgagtaagttcttgaacattcagtgtcaactcagcaggctcaaataccctccttttgcgaaaaagtggatcaatattcggaagtcatatggaaatttttacaaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacaataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggctgctgcctatttttgtatggcctacaaactatggtttttatattcccttttgttaatggctcaaaataatattttgtataatacgaaaattacgaaattttagtttctctaaataaagttttggaaagaac

SEQ ID NO: 131583 - DNA, 557 bp, Homo sapiens
  Payload ID: 5678
  Gene Symbol: ERI1
  Gene Name: exoribonuclease 1
  ENST ID: ENST00000521844
  CDS Start-End: 174-308
gacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgagtgcccctcgctgccttgtgttctttgacattggaaagaaggtctcgttaaggatctctgtatgttccttttgccctgtgtgcacttcctttggatccttgcaattatctttctccttctaaggttgttatttcaaagagtacttgcacatcccttctcttgtaaagaaccactcttccacctgcctccctcttcagcctgagatacgttgtcaatctcatcctgaaactcaacagtgtaaatttgatggccaggagacaaaaggatccaagttcat
